United States Patent
Raitano et al.

(10) Patent No.: US 7,449,548 B2
(45) Date of Patent: Nov. 11, 2008

(54) NUCLEIC ACID AND CORRESPONDING PROTEIN ENTITLED 193P1E1B USEFUL IN TREATMENT AND DETECTION OF CANCER

(75) Inventors: Arthur B. Raitano, Los Angeles, CA (US); Pia M. Challita-Eid, Encino, CA (US); Mary Faris, Los Angeles, CA (US); Rene S Hubert, Los Angeles, CA (US); Wangmao Ge, Culver City, CA (US); Aya Jakobovits, Beverly Hills, CA (US)

(73) Assignee: Agensys, Inc., Santa Monica, CA (US)

( * ) Notice: Subject to any disclaimer, the term of this patent is extended or adjusted under 35 U.S.C. 154(b) by 259 days.

(21) Appl. No.: 10/013,312

(22) Filed: Dec. 7, 2001

(65) Prior Publication Data

US 2003/0223990 A1 Dec. 4, 2003

(51) Int. Cl.
C07K 14/00 (2006.01)
(52) U.S. Cl. .................................. 530/350
(58) Field of Classification Search ............... 530/350; 424/184.1
See application file for complete search history.

(56) References Cited

U.S. PATENT DOCUMENTS

| | | | |
|---|---|---|---|
| 5,643,778 A | 7/1997 | Nishikura | |
| 5,840,839 A * | 11/1998 | Wang et al. | 530/325 |

FOREIGN PATENT DOCUMENTS

| | | |
|---|---|---|
| EP | 1 308 459 | 5/2003 |
| WO | WO9839446 A2 | 9/1998 |
| WO | WO9845435 A2 | 10/1998 |
| WO | WO9906548 A2 | 2/1999 |
| WO | WO9931236 A2 | 6/1999 |
| WO | WO9938972 A2 | 8/1999 |
| WO | WO9958675 A2 | 11/1999 |
| WO | WO0018916 A2 | 4/2000 |
| WO | WO0021991 A1 | 4/2000 |
| WO | WO-01/12811 | 2/2001 |
| WO | WO0122920 A2 | 4/2001 |
| WO | WO0142302 A1 | 6/2001 |
| WO | WO0142451 A2 | 6/2001 |
| WO | WO0160860 A2 | 8/2001 |
| WO | WO-01/90157 | 11/2001 |
| WO | WO0229086 A2 | 4/2002 |
| WO | WO0240718 A2 | 5/2002 |
| WO | WO0248337 A2 | 6/2002 |
| WO | WO02074961 | 9/2002 |
| WO | WO02085298 | 10/2002 |

OTHER PUBLICATIONS

Alberts et al. (Molecular Biology of the Cell, 3rd edition, 1994, p. 465).*
Shantz and Pegg (Int J of Biochem and Cell Biol., 1999, vol. 31, pp. 107-122).*
McClean and Hill (Eur J of Cancer, 1993, vol. 29A, pp. 2243-2248).*
Fu et al (EMBO Journal, 1996, vol. 15, pp. 4392-4401).*
Bussenmakers et al., Cancer Res. Dec. 1, 1999;59 :5975-79.*
Scott et al (Nature Genetics, 1999, 21:440-443).*
Skolnick et al. (2000, Trends in Biotech. 18:34-39).*
Bork (2000, Genome Research 10:398-400).*
Doerks et al. (1998, Trends in Genetics 14:248-250).*
Smith et al. (1997, Nature Biotechnology 15:1222-1223).*
Brenner (1999, Trends in Genetics 15:132-133).*
Bork et al. (1996, Trends in Genetics 12:425-427).*
Bowie et al. (1990, Science 247:1306-1310).*
Sherman, LA et al, 1998, Critical reviews in Immunol, 18(1-2): 47-54.*
Lauritzsen et al (International Journal of Cancer, 1998, vol. 78, pp. 216-222).*
Sarma et al (Journal of Experimental Medicine, 1999, vol. 189, pp. 811-820).*
Ezzell (J. NIH Res, 1995, 7:46-49).*
Spitler (Cancer Biotherapy, 1995, 10: 1-3).*
Boon (Adv Can Res, 1992, 58:177-210).*
Gura (Science, 1997, 278:1041-1042).*
Jain (Sci. Am., 1994, 271:58-65).*
Curti (Crit. Rev. in Oncology/Hematology, 1993, 14:29-39).*
Wang et al., J Biol Chem. Aug. 29, 1997;272 (35):22227-35.*
NCBI Accession No. BC013418 (Sep. 4, 2001).*
Broder et al., Curr Opin Biotechnol. Dec. 2000; 11(6):581-5.*
Benjamini and Leskowitz (1993, Immunology, 2nd edition, Chapter 3 only, pp. 37-45).*
You et al., Neoplasia. Jun. 2007; 9(6): 464-470.*
International Search Report for PCT/US02/39274, mailed on Oct. 6, 2004, 3 pages.
Ota et al., Nat. Genet. (2004) 36(1):40-45.
Shibata et al., Genome Res. (2000) 10(11):1757-1771.
Thai et al., Adv. Immunol. (2005) 86:113-136 (abstract only).
Greenbaum et al., Genome Biology (2003) 4(9):117.1-117.8.
Database EMBL, EBI accession No. EMBL:BC013418 (2001).
Database EMBL, EBI accession No. EMBL:BG392826 (2001).
Database EMBL, EBI accession No. EMBL:AL561096 (2001).
Database EMBL, EBI accession No. EMBL:AL519504 (2001).
Database EMBL, EBI accession No. EMBL:AK090584 (2002).
Supplementary Partial European Search Report for EP 02797238.9, mailed Oct. 12, 2007, 7 pages.
Hubert et al., PNAS USA (1999) 96(25):14523-14528.
Japanese Office Action for Application No. 2003-551277, mailed on Feb. 15, 2008, 7 pages.
Klein et al., Nature Medicine (1997) 3(4):402-408.

* cited by examiner

*Primary Examiner*—Misook Yu
(74) *Attorney, Agent, or Firm*—Morrison & Foerster LLP

(57) ABSTRACT

A novel gene (designated 193P1E1B) and its encoded protein, and variants thereof, are described wherein 193P1E1B exhibits tissue specific expression in normal adult tissue, and is aberrantly expressed in the cancers listed in Table I. Consequently, 193P1E1B provides a diagnostic, prognostic, prophylactic and/or therapeutic target for cancer. The 193P1E1B gene or fragment thereof, or its encoded protein, or variants thereof, or a fragment thereof, can be used to elicit a humoral or cellular immune response; antibodies or T cells reactive with 191P1E1B can be used in active or passive immunization.

5 Claims, 41 Drawing Sheets

Figure 1: 193P1E1B SSH sequence of 227 nucleotides (SEQ ID NO: 2982)

```
  1 GATCCACTGG AATTTCAGTT TTCTTTGTTG CTGACATCTC GGATGTTCTG TCCATGT
TTA
 61 GGGAACCTTT TACTGGGTGG CACTGCTTTA ATTGCTATTG GAGTAGCTAG GTTTGAG
TTG
121 TATTTTGATA GAAGCTGGAG AATATCTTCT GGAATTTTAG TTACTTCTGG AGGGGGN
AGG
181 TTCTGAGCAG ATTCTCATAA GAAGAAATCG TAGGTGAAAG AGGGATC
```

Figure 2A. The cDNA (SEQ ID. NO. :1308) and amino acid sequence (SEQ ID. NO. :2983) of 193P1E1B v.1. The start methionine is underlined. The open reading frame extends from nucleic acid 805-2043 including the stop codon.

```
   1 tatcatctgtgactgaggaaatccctatcttcctatcagactaatgaaaccacaggacag
  61 caattagacttttaagtattggggggtttagagctctagatattcgatatgcagactact
 121 catgtttgtttgttttaataaagactggtccaaaggctcattttcacacaagctacagtt
 181 tttcagttccaggaccaggtaaagatggtcagctccgtgatccataaaatccaagggtga
 241 cgactcaggattaggaccatttcttggtgacattgagatggtcgagctggtccgcaatga
 301 atctatgcggggggaacttggaagtggcggccgcctttatggcctcgaaggcctccctcc
 361 tgcgcaccgcggcgtggccgcgctcctgctcccgggtcatgtagggcatgctcagccagt
 421 aatggttctccgcctcgatctccaggcggcggatcatgttctgcttggcgcgcaacgaca
 481 cgaaccgcggccgccggtgcttcccgatccactgacggccgggaatgcggccgcgccaga
 541 ggagcgcagtcaggaacatggtgcctgccgcgctgctcaagactctgcgtctccgcggcc
 601 gccagcagacgccgtggcgtaagcgcaccgtctcgcggggtctccgggggcctcggcga
 661 gagacttcggctctcgcgagagaggactgcgcctgcgcagagccgaggacgcgtccggcg
 721 ccgagattcaaactagtggcgggaggctgtgagctgagcggtggggtctgcgtacgcctg
   1                          M  D  P  I  R  S  F  C  G  K  L  R
 781 gagtccttccccgctgtgctcagcATGGACCCTATCCGGAGCTTCTGCGGGAAGCTGCGG
  13 S  L  A  S  T  L  D  C  E  T  A  R  L  Q  R  A  L  D  G  E
 841 TCTCTGGCCAGCACGCTGGACTGCGAGACGGCCCGGCTGCAGCGAGCGCTGGACGGAGAG
  33 E  S  D  F  E  D  Y  P  M  R  I  L  Y  D  L  H  S  E  V  Q
 901 GAAAGCGACTTTGAAGATTATCCAATGAGAATTTTATATGACCTTCATTCAGAAGTTCAG
  53 T  L  K  D  D  V  N  I  L  L  D  K  A  R  L  E  N  Q  E  G
 961 ACTCTAAAGGATGATGTTAATATTCTTCTTGATAAAGCAAGATTGGAAAATCAAGAAGGC
  73 I  D  F  I  K  A  T  K  V  L  M  E  K  N  S  M  D  I  M  K
1021 ATTGATTTCATAAAGGCAACAAAAGTACTAATGGAAAAAAATTCAATGGATATTATGAAA
  93 I  R  E  Y  F  Q  K  Y  G  Y  S  P  R  V  K  K  N  S  V  H
1081 ATAAGAGAGTATTTCCAGAAGTATGGATATAGTCCACGTGTCAAGAAAAATTCAGTACAC
 113 E  Q  E  A  I  N  S  D  P  E  L  S  N  C  E  N  F  Q  K  T
1141 GAGCAAGAAGCCATTAACTCTGACCCAGAGTTGTCTAATTGTGAAAATTTTCAGAAGACT
 133 D  V  K  D  D  L  S  D  P  P  V  A  S  S  C  I  S  E  K  S
1201 GATGTGAAAGATGATCTGTCTGATCCTCCTGTTGCAAGCAGTTGTATTTCTGAGAAGTCT
 153 P  R  S  P  Q  L  S  D  F  G  L  E  R  Y  I  V  S  Q  V  L
1261 CCACGTAGTCCACAACTTTCAGATTTTGGACTTGAGCGGTACATCGTATCCCAAGTTCTA
 173 P  N  P  P  Q  A  V  N  N  Y  K  E  E  P  V  I  V  T  P  P
1321 CCAAACCCTCCACAGGCAGTGAACAACTATAAGGAAGAGCCCGTAATTGTAACCCCACCT
```

```
193  T   K   Q   S   L   V   K   V   L   K   T   P   K   C   A   L   K   M   D   D
1381 ACCAAACAATCACTAGTAAAAGTACTAAAAACTCCAAAATGTGCACTAAAAATGGATGAT
213  F   E   C   V   T   P   K   L   E   H   F   G   I   S   E   Y   T   M   C   L
1441 TTTGAGTGTGTAACTCCTAAATTAGAACACTTTGGTATCTCTGAATATACTATGTGTTTA
233  N   E   D   Y   T   M   G   L   K   N   A   R   N   N   K   S   E   E   A   I
1501 AATGAAGATTACACAATGGGACTTAAAAATGCGAGGAATAATAAAAGTGAGGAGGCCATA
253  D   T   E   S   R   L   N   D   N   V   F   A   T   P   S   P   I   I   Q   Q
1561 GATACAGAATCCAGGCTCAATGATAATGTTTTTGCCACTCCCAGCCCCATCATCCAGCAG
273  L   E   K   S   D   A   E   Y   T   N   S   P   L   V   P   T   F   C   T   P
1621 TTGGAAAAAAGTGATGCCGAATATACCAACTCTCCTTTGGTACCTACATTCTGTACTCCT
293  G   L   K   I   P   S   T   K   N   S   I   A   L   V   S   T   N   Y   P   L
1681 GGTTTGAAAATTCCATCTACAAAGAACAGCATAGCTTTGGTATCCACAAATTACCCATTA
313  S   K   T   N   S   S   S   N   D   L   E   V   E   D   R   T   S   L   V   L
1741 TCAAAAACAAATAGTTCATCAAATGATTTGGAAGTTGAAGATCGTACTTCGTTGGTTTTA
333  N   S   D   T   C   F   E   N   L   T   D   P   S   S   P   T   I   S   S   Y
1801 AATTCAGACACATGCTTTGAGAATTTAACAGATCCCTCTTCACCTACGATTTCTTCTTAT
353  E   N   L   L   R   T   P   T   P   P   E   V   T   K   I   P   E   D   I   L
1861 GAGAATCTGCTCAGAACACCTACACCTCCAGAAGTAACTAAAATTCCAGAAGATATTCTC
373  Q   L   L   S   K   Y   N   S   N   L   A   T   P   I   A   I   K   A   V   P
1921 CAGCTTTTATCAAAATACAACTCAAACCTAGCTACTCCAATAGCAATTAAAGCAGTGCCA
393  P   S   K   R   F   L   K   H   G   Q   N   I   R   D   V   S   N   K   E   N
1981 CCCAGTAAAAGGTTCCTTAAACATGGACAGAACATCCGAGATGTCAGCAACAAAGAAAAC
413  *
2041 TGAaattccagtggatctatccaacacagaaactgaacaaaatgagatgaaagccgagct
2101 ggaccgatttttaacattcacattgccctgcctctgtccccctttaaacgttgacccattt
2161 taaagacaaacatgaacattaacatcataatatgcttttatgaagtttcaataaggttt
2221 aaccttagtcttgttgacatgtagcccagtcattcactctttaaggactattagtgtttc
2281 attgatactaaattacccagcttaatcaacagaatggtttaagtagtaccaggaagtagg
2341 acaagtaatttcaaaaatataaaggtgtttgctactcagatgaggccgccctgaccttc
2401 tggccagagagacattgctgccagccagctctgccttcccatcatctcctttcaggaccg
2461 tcccacaccttttacttgctcagtgctgtctgaagatgcagttgctgtttgcaaacaaca
2521 ggaacaccagttaaactaattaggaaacagagggagatttccaggcctgggtaactatat
2581 actgtgaccattggcggttgagaccggtcttcaaccagtggaaccccgaactctgctgtc
2641 agggtgtggacttcggtgctcttccaagttttcacctggggggggagctaaccccctat
2701 gttcacgccttctattcccattggcgctgaactcttaaggtcactctggtcgcttgtgac
2761 cccgtaaccctgatgtacccctctaaaaggtgagggc
```

Figure 2B. The cDNA (SEQ ID. NO. :2984) and amino acid sequence (SEQ ID. NO. :2985) of 193P1E1B v.2. The start methionine is underlined. The open reading frame extends from nucleic acid 805-2043 including the stop codon.

```
   1 tatcatctgtgactgaggaaatccctatcttcctatcagactaatgaaaccacaggacag
  61 caattagacttttaagtattgggggggtttagagctctagatattcgatatgcagactact
 121 catgtttgtttgttttaataaagactggtccaaaggctcattttcacacaagctacagtt
 181 tttcagttccaggaccaggtaaagatggtcagctccgtgatccataaaatccaagggtga
 241 cgactcaggattaggaccatttcttggtgacattgagatggtcgagctggtccgcaatga
 301 atctatgcgggggggaacttggaagtggcggccgcctttatggcctcgaaggcctccctcc
 361 tgcgcaccgcggcgtggccgcgctcctgctcccgggtcatgtagggcatgctcagccagt
 421 aatggttctccgcctcgatctccaggcggcggatcatgttctgcttggcgcgcaacgaca
 481 cgaaccgcggccgccggtgcttcccgatccactgacggccgggaatgcggccgcgccaga
 541 ggagcgcagtcaggaacatggtgcctgccgcgctgctcaagactctgcgtctccgcggcc
 601 gccagcagacgccgtggcgtaagcgcaccgtctcgcggggtctccgggggcctcggcga
 661 gagacttcggctctcgcgagagaggactgcgcctgcgcagagccgaggacgcgtccggcg
 721 ccgagattcaaactagtggcgggaggctgtgagctgagcggtggggtctgcgtacgcctg
                          M  D  P  I  R  S  F  C  G  K  L  R
 781 gagtccttccccgctgtgctcagcATGGACCCTATCCGGAGCTTCTGCGGGAAGCTGCGG
  13 S  L  A  S  T  L  D  C  E  T  A  R  L  Q  R  A  L  D  G  E
 841 TCTCTGGCCAGCACGCTGGACTGCGAGACGGCCCGGCTGCAGCGAGCGCTGGACGGAGAG
  33 E  S  D  F  E  D  Y  P  M  R  I  L  Y  D  L  H  S  E  V  Q
 901 GAAAGCGACTTTGAAGATTATCCAATGAGAATTTTATATGACCTTCATTCAGAAGTTCAG
  53 T  L  K  D  D  V  N  I  L  L  D  K  A  R  L  E  N  Q  E  G
 961 ACTCTAAAGGATGATGTTAATATTCTTCTTGATAAAGCAAGATTGGAAAATCAAGAAGGC
  73 I  D  F  I  K  A  T  K  V  L  M  E  K  N  S  M  D  I  M  K
1021 ATTGATTTCATAAAGGCAACAAAAGTACTAATGGAAAAAAATTCAATGGATATTATGAAA
  93 I  R  E  Y  F  Q  K  Y  G  Y  S  P  R  V  K  K  N  S  V  H
1081 ATAAGAGAGTATTTCCAGAAGTATGGATATAGTCCACGTGTCAAGAAAAATTCAGTACAC
 113 E  Q  E  A  I  N  S  D  P  E  L  S  N  C  E  N  F  Q  K  T
1141 GAGCAAGAAGCCATTAACTCTGACCCAGAGTTGTCTAATTGTGAAAATTTTCAGAAGACT
 133 D  V  K  D  D  L  S  D  P  P  V  A  S  S  C  I  S  G  K  S
1201 GATGTGAAAGATGATCTGTCTGATCCTCCTGTTGCAAGCAGTTGTATTTCTGGGAAGTCT
 153 P  R  S  P  Q  L  S  D  F  G  L  E  R  Y  I  V  S  Q  V  L
1261 CCACGTAGTCCACAACTTTCAGATTTTGGACTTGAGCGGTACATCGTATCCCAAGTTCTA
 173 P  N  P  P  Q  A  V  N  N  Y  K  E  E  P  V  I  V  T  P  P
1321 CCAAACCCTCCACAGGCAGTGAACAACTATAAGGAAGAGCCCGTAATTGTAACCCCACCT
```

```
193  T   K   Q   S   L   V   K   V   L   K   T   P   K   C   A   L   K   M   D   D
1381 ACCAAACAATCACTAGTAAAAGTACTAAAAACTCCAAAATGTGCACTAAAAATGGATGAT
213  F   E   C   V   T   P   K   L   E   H   F   G   I   S   E   Y   T   M   C   L
1441 TTTGAGTGTGTAACTCCTAAATTAGAACACTTTGGTATCTCTGAATATACTATGTGTTTA
233  N   E   D   Y   T   M   G   L   K   N   A   R   N   N   K   S   E   E   A   I
1501 AATGAAGATTACACAATGGGACTTAAAAATGCGAGGAATAATAAAAGTGAGGAGGCCATA
253  D   T   E   S   R   L   N   D   N   V   F   A   T   P   S   P   I   I   Q   Q
1561 GATACAGAATCCAGGCTCAATGATAATGTTTTTGCCACTCCCAGCCCCATCATCCAGCAG
273  L   E   K   S   D   A   E   Y   T   N   S   P   L   V   P   T   F   C   T   P
1621 TTGGAAAAAAGTGATGCCGAATATACCAACTCTCCTTTGGTACCTACATTCTGTACTCCT
293  G   L   K   I   P   S   T   K   N   S   I   A   L   V   S   T   N   Y   P   L
1681 GGTTTGAAAATTCCATCTACAAAGAACAGCATAGCTTTGGTATCCACAAATTACCCATTA
313  S   K   T   N   S   S   S   N   D   L   E   V   E   D   R   T   S   L   V   L
1741 TCAAAAACAAATAGTTCATCAAATGATTTGGAAGTTGAAGATCGTACTTCGTTGGTTTTA
333  N   S   D   T   C   F   E   N   L   T   D   P   S   S   P   T   I   S   S   Y
1801 AATTCAGACACATGCTTTGAGAATTTAACAGATCCCTCTTCACCTACGATTTCTTCTTAT
353  E   N   L   R   T   P   T   P   P   E   V   T   K   I   P   E   D   I   L
1861 GAGAATCTGCTCAGAACACCTACACCTCCAGAAGTAACTAAAATTCCAGAAGATATTCTC
373  Q   L   L   S   K   Y   N   S   N   L   A   T   P   I   A   I   K   A   V   P
1921 CAGCTTTTATCAAAATACAACTCAAACCTAGCTACTCCAATAGCAATTAAAGCAGTGCCA
393  P   S   K   R   F   L   K   H   Q   N   I   R   D   V   S   N   K   E   N
1981 CCCAGTAAAAGGTTCCTTAAACATGGACAGAACATCCGAGATGTCAGCAACAAAGAAAAC
413  *
2041 TGAaattccagtggatctatccaacacagaaactgaacaaaatgagatgaaagccgagct
2101 ggaccgattttaacattcacattgccctgcctctgtccccctttaaacgttgacccattt
2161 taaagacaaacatgaacattaacatcataatatgcttttatgaagtttcaataaggttt
2221 aaccttagtcttgttgacatgtagcccagtcattcactctttaaggactattagtgtttc
2281 attgatactaaattacccagcttaatcaacagaatggtttaagtagtaccaggaagtagg
2341 acaagtaatttcaaaaatataaaggtgtttgctactcagatgaggccgcccctgaccttc
2401 tggccagagagacattgctgccagccagctctgccttcccatcatctcctttcaggaccg
2461 tcccacaccttttacttgctcagtgctgtctgaagatgcagttgctgtttgcaaacaaca
2521 ggaacaccagttaaactaattaggaaacagagggagatttccaggcctgggtaactatat
2581 actgtgaccattggcggttgagaccggtcttcaaccagtggaaccccgaactctgctgtc
2641 agggtgtggacttcggtgctcttccaagttttcacctggggggggagctaaccccctat
2701 gttcacgccttctattccattggcgctgaactcttaaggtcactctggtcgcttgtgac
2761 cccgtaaccctgatgtacccctctaaaaggtgaggggc
```

Figure 2C. The cDNA (SEQ ID. NO. :2986) and amino acid sequence (SEQ ID. NO. :1310) of 193P1E1B v.3. The start methionine is underlined. The open reading frame extends from nucleic acid 185-1177 including the stop codon.

```
   1 atggaccctatccggagcttctgcgggaagctgcggtctctggccagcacgctggactgc
  61 gagacggcccggctgcagcgagcgctggacggagaggaaagcggatgatgttaatattct
 121 tcttgataaagcaagattggaaaatcaagaaggcattgatttcataaaggcaacaaaagt
   1     M  E  K  N  S  M  D  I  M  K  I  R  E  Y  F  Q  K  Y  G
 181 actaATGGAAAAAAATTCAATGGATATTATGAAAATAAGAGAGTATTTCCAGAAGTATGG
  20  Y  S  P  R  V  K  K  N  S  V  H  E  Q  E  A  I  N  S  D  P
 241 ATATAGTCCACGTGTCAAGAAAAATTCAGTACACGAGCAAGAAGCCATTAACTCTGACCC
  40  E  L  S  N  C  E  N  F  Q  K  T  D  V  K  D  D  L  S  D  P
 301 AGAGTTGTCTAATTGTGAAAATTTTCAGAAGACTGATGTGAAAGATGATCTGTCTGATCC
  60  P  V  A  S  S  C  I  S  E  K  S  P  R  S  P  Q  L  S  D  F
 361 TCCTGTTGCAAGCAGTTGTATTTCTGAGAAGTCTCCACGTAGTCCACAACTTTCAGATTT
  80  G  L  E  R  Y  I  V  S  Q  V  L  P  N  P  P  Q  A  V  N  N
 421 TGGACTTGAGCGGTACATCGTATCCCAAGTTCTACCAAACCCTCCACAGGCAGTGAACAA
 100  Y  K  E  E  P  V  I  V  T  P  P  T  K  Q  S  L  V  K  V  L
 481 CTATAAGGAAGAGCCCGTAATTGTAACCCCACCTACCAAACAATCACTAGTAAAAGTACT
 120  K  T  P  K  C  A  L  K  M  D  D  F  E  C  V  T  P  K  L  E
 541 AAAAACTCCAAAATGTGCACTAAAAATGGATGATTTTGAGTGTGTAACTCCTAAATTAGA
 140  H  F  G  I  S  E  Y  T  M  C  L  N  E  D  Y  T  M  G  L  K
 601 ACACTTTGGTATCTCTGAATATACTATGTGTTTAAATGAAGATTACACAATGGGACTTAA
 160  N  A  R  N  N  K  S  E  E  A  I  D  A  E  S  R  L  N  D  N
 661 AAATGCGAGGAATAATAAAAGTGAGGAGGCCATAGATGCAGAATCCAGGCTCAATGATAA
 180  V  F  A  T  P  S  P  I  I  Q  Q  L  E  K  S  D  A  E  Y  T
 721 TGTTTTTGCCACTCCCAGCCCCATCATCCAGCAGTTGGAAAAAAGTGATGCCGAATATAC
 200  N  S  P  L  V  P  T  F  C  T  P  G  L  K  I  P  S  T  K  N
 781 CAACTCTCCTTTGGTACCTACATTCTGTACTCCTGGTTTGAAAATTCCATCTACAAAGAA
 220  S  I  A  L  V  S  T  N  Y  P  L  S  K  T  N  S  S  N  D
 841 CAGCATAGCTTTGGTATCCACAAATTACCCATTATCAAAAACAAATAGTTCATCAAATGA
 240  L  E  V  E  D  R  T  S  L  V  L  N  S  D  T  C  F  E  N  L
 901 TTTGGAAGTTGAAGATCGTACTTCGTTGGTTTTAAATTCAGACACATGCTTTGAGAATTT
 260  T  D  P  S  S  P  T  I  S  S  Y  E  N  L  L  R  T  P  T  P
 961 AACAGATCCCTCTTCACCTACGATTTCTTCTTATGAGAATCTGCTCAGAACACCTACACC
 280  P  E  V  T  K  I  P  E  D  I  L  Q  L  L  S  K  Y  N  S  N
1021 TCCAGAAGTAACTAAAATTCCAGAAGATATTCTCCAGCTTTTATCAAAATACAACTCAAA
```

```
300  L  A  T  P  I  A  I  K  A  V  P  P  S  K  R  F  L  K  H  G
1081 CCTAGCTACTCCAATAGCAATTAAAGCAGTGCCACCCAGTAAAAGGTTCCTTAAACATGG

320  Q  N  I  R  D  V  S  N  K  E  N  *
1141 ACAGAACATCCGAGATGTCAGCAACAAAGAAAACTGA
```

Figure 2D. The cDNA (SEQ ID. NO. :1311) and amino acid sequence (SEQ ID. NO. :1313) of 193P1E1B v.4. The start methionine is underlined. The open reading frame extends from nucleic acid 805-1971 including the stop codon.

```
   1 tatcatctgtgactgaggaaatccctatcttcctatcagactaatgaaaccacaggacag
  61 caattagacttttaagtattgggggggtttagagctctagatattcgatatgcagactact
 121 catgtttgtttgttttaataaagactggtccaaaggctcattttcacacaagctacagtt
 181 tttcagttccaggaccaggtaaagatggtcagctccgtgatccataaaatccaagggtga
 241 cgactcaggattaggaccatttcttggtgacattgagatggtcgagctggtccgcaatga
 301 atctatgcggggggaacttggaagtggcggccgcctttatggcctcgaaggcctccctcc
 361 tgcgcaccgcggcgtggccgcgctcctgctcccgggtcatgtagggcatgctcagccagt
 421 aatggttctccgcctcgatctccaggcggcggatcatgttctgcttggcgcgcaacgaca
 481 cgaaccgcggccgccggtgcttcccgatccactgacggccgggaatgcggccgcgccaga
 541 ggagcgcagtcaggaacatggtgcctgccgcgctgctcaagactctgcgtctccgcggcc
 601 gccagcagacgccgtggcgtaagcgcacccgtctcgcggggtctccggggggcctcggcga
 661 gagacttcggctctcgcgagagaggactgcgcctgcgcagagccgaggacgcgtccggcg
 721 ccgagattcaaactagtggcgggaggctgtgagctgagcggtggggtctgcgtacgcctg
   1                                          M  D  P  I  R  S  F  C  G  K  L  R
 781 gagtccttccccgctgtgctcagcATGGACCCTATCCGGAGCTTCTGCGGGAAGCTGCGG
  13  S  L  A  S  T  L  D  C  E  T  A  R  L  Q  R  A  L  D  G  E
 841 TCTCTGGCCAGCACGCTGGACTGCGAGACGGCCCGGCTGCAGCGAGCGCTGGACGGAGAG
  33  E  S  D  F  E  D  Y  P  M  R  I  L  Y  D  L  H  S  E  V  Q
 901 GAAAGCGACTTTGAAGATTATCCAATGAGAATTTTATATGACCTTCATTCAGAAGTTCAG
  53  T  L  K  D  D  V  N  I  L  L  D  K  A  R  L  E  N  Q  E  G
 961 ACTCTAAAGGATGATGTTAATATTCTTCTTGATAAAGCAAGATTGGAAAATCAAGAAGGC
  73  I  D  F  I  K  A  T  K  V  L  M  E  K  N  S  M  D  I  M  K
1021 ATTGATTTCATAAAGGCAACAAAAGTACTAATGGAAAAAAATTCAATGGATATTATGAAA
  93  I  R  E  Y  F  Q  K  Y  G  Y  S  P  R  V  K  K  N  S  V  H
1081 ATAAGAGAGTATTTCCAGAAGTATGGATATAGTCCACGTGTCAAGAAAAATTCAGTACAC
 113  E  Q  E  A  I  N  S  D  P  E  L  S  N  C  E  N  F  Q  K  T
1141 GAGCAAGAAGCCATTAACTCTGACCCAGAGTTGTCTAATTGTGAAAATTTTCAGAAGACT
 133  D  V  K  D  D  L  S  D  P  P  V  A  S  S  C  I  S  E  K  S
1201 GATGTGAAAGATGATCTGTCTGATCCTCCTGTTGCAAGCAGTTGTATTTCTGAGAAGTCT
 153  P  R  S  P  Q  L  S  D  F  G  L  E  R  Y  I  V  S  Q  V  L
1261 CCACGTAGTCCACAACTTTCAGATTTTGGACTTGAGCGGTACATCGTATCCCAAGTTCTA
 173  P  N  P  P  Q  A  V  N  N  Y  K  E  E  P  V  I  V  T  P  P
```

```
1321 CCAAACCCTCCACAGGCAGTGAACAACTATAAGGAAGAGCCCGTAATTGTAACCCCACCT
 193 T   K   Q   S   L   V   K   V   L   K   T   P   K   C   A   L   K   M   D   D
1381 ACCAAACAATCACTAGTAAAAGTACTAAAAACTCCAAAATGTGCACTAAAAATGGATGAT
 213 F   E   C   V   T   P   K   L   E   H   F   G   I   S   E   Y   T   M   C   L
1441 TTTGAGTGTGTAACTCCTAAATTAGAACACTTTGGTATCTCTGAATATACTATGTGTTTA
 233 N   E   D   Y   T   M   G   L   K   N   A   R   N   N   K   S   E   E   A   I
1501 AATGAAGATTACACAATGGGACTTAAAAATGCGAGGAATAATAAAAGTGAGGAGGCCATA
 253 D   T   E   S   R   L   N   D   N   V   F   A   T   P   S   P   I   I   Q   Q
1561 GATACAGAATCCAGGCTCAATGATAATGTTTTTGCCACTCCCAGCCCCATCATCCAGCAG
 273 L   E   K   S   D   A   E   Y   T   N   S   P   L   V   P   T   F   C   T   P
1621 TTGGAAAAAAGTGATGCCGAATATACCAACTCTCCTTTGGTACCTACATTCTGTACTCCT
 293 G   L   K   I   P   S   T   K   N   S   I   A   L   V   S   T   N   Y   P   L
1681 GGTTTGAAAATTCCATCTACAAAGAACAGCATAGCTTTGGTATCCACAAATTACCCATTA
 313 S   K   T   N   S   S   S   N   D   L   E   V   E   D   R   T   S   L   V   L
1741 TCAAAAACAAATAGTTCATCAAATGATTTGGAAGTTGAAGATCGTACTTCGTTGGTTTTA
 333 N   S   D   T   C   F   E   N   L   T   D   P   S   S   P   T   I   S   S   Y
1801 AATTCAGACACATGCTTTGAGAATTTAACAGATCCCTCTTCACCTACGATTTCTTCTTAT
 353 E   N   L   L   R   T   P   T   P   P   E   V   T   K   I   P   E   D   I   L
1861 GAGAATCTGCTCAGAACACCTACACCTCCAGAAGTAACTAAAATTCCAGAAGATATTCTC
 373 Q   K   F   Q   W   I   Y   P   T   Q   K   L   N   K   M   R   *
1921 CAGAAATTCCAGTGGATCTATCCAACACAGAAACTGAACAAAATGAGATGAaagccgagc
1981 tggaccgattttaacattcacattgccctgcctctgtccccctttaaacgttgacccatt
2041 ttaaagacaaacatgaacattaacatcataatatgcttttatgaagtttcaataaggtt
2101 taaccttagtcttgttgacatgtagcccagtcattcactcttaaggactattagtgttt
2161 cattgatactaaattacccagcttaatcaacagaatggtttaagtagtaccaggaagtag
2221 gacaagtaatttcaaaaatataaaggtgtttgctactcagatgaggccgcccctgacctt
2281 ctggccagagagacattgctgccagccagctctgccttccatcatctcctttcaggacc
2341 gtcccacaccttttacttgctcagtgctgtctgaagatgcagttgctgtttgcaaacaac
2401 aggaacaccagttaaactaattaggaaacagagggagatttccaggcctgggtaactata
2461 tactgtgaccattggcggttgagaccggtcttcaaccagtggaaccccgaactctgctgt
2521 cagggtgtggacttcggtgctcttccaagttttcacctgggggggggagctaaccccta
2581 tgttcacgccttctattcccattggcgctgaactcttaaggtcactctggtcgcttgtga
2641 ccccgtaaccctgatgtacccctctaaaaggtgaggggc
```

Figure 2E. The cDNA (SEQ ID. NO. :1314) and amino acid sequence (SEQ ID. NO. :1315) of 193P1E1B v.5. The start methionine is underlined. The open reading frame extends from nucleic acid 989-1909 including the stop codon.

```
   1 tatcatctgtgactgaggaaatccctatcttcctatcagactaatgaaaccacaggacag
  61 caattagacttttaagtattggggggtttagagctctagatattcgatatgcagactact
 121 catgtttgtttgttttaataaagactggtccaaaggctcattttcacacaagctacagtt
 181 tttcagttccaggaccaggtaaagatggtcagctccgtgatccataaaatccaagggtga
 241 cgactcaggattaggaccatttcttggtgacattgagatggtcgagctggtccgcaatga
 301 atctatgcggggggaacttggaagtggcggccgcctttatggcctcgaaggcctccctcc
 361 tgcgcaccgcggcgtggccgcgctcctgctcccgggtcatgtagggcatgctcagccagt
 421 aatggttctccgcctcgatctccaggcggcggatcatgttctgcttggcgcgcaacgaca
 481 cgaaccgcggccgccggtgcttcccgatccactgacggccgggaatgcggccgcgccaga
 541 ggagcgcagtcaggaacatggtgcctgccgcgctgctcaagactctgcgtctccgcggcc
 601 gccagcagacgccgtggcgtaagcgcaccgtctcgcggggtctccggggcctcggcga
 661 gagacttcggctctcgcgagagaggactgcgcctgcgcagagccgaggacgcgtccggcg
 721 ccgagattcaaactagtggcgggaggctgtgagctgagcggtggggtctgcgtacgcctg
 781 gagtccttccccgctgtgctcagcatggaccctatccggagcttctgcgggaagctgcgg
 841 tctctggccagcacgctggactgcgagacggcccggctgcagcgagcgctggacggagag
 901 gaaagcggatgatgttaatattcttcttgataaagcaagattggaaaatcaagaaggcat
   1                                M  E  K  N  S  M  D  I  M  K  I
 961 tgatttcataaaggcaacaaaagtactaATGGAAAAAAATTCAATGGATATTATGAAAAT
  12  R  E  Y  F  Q  K  Y  G  Y  S  P  R  V  K  K  N  S  V  H  E
1021 AAGAGAGTATTTCCAGAAGTATGGATATAGTCCACGTGTCAAGAAAAATTCAGTACACGA
  32  Q  E  A  I  N  S  D  P  E  L  S  N  C  E  N  F  Q  K  T  D
1081 GCAAGAAGCCATTAACTCTGACCCAGAGTTGTCTAATTGTGAAAATTTTCAGAAGACTGA
  52  V  K  D  D  L  S  D  P  P  V  A  S  S  C  I  S  E  K  S  P
1141 TGTGAAAGATGATCTGTCTGATCCTCCTGTTGCAAGCAGTTGTATTTCTGAGAAGTCTCC
  72  R  S  P  Q  L  S  D  F  G  L  E  R  Y  I  V  S  Q  V  L  P
1201 ACGTAGTCCACAACTTTCAGATTTTGGACTTGAGCGGTACATCGTATCCCAAGTTCTACC
  92  N  P  P  Q  A  V  N  N  Y  K  E  E  P  V  I  V  T  P  P  T
1261 AAACCCTCCACAGGCAGTGAACAACTATAAGGAAGAGCCCGTAATTGTAACCCCACCTAC
 112  K  Q  S  L  V  K  V  L  K  T  P  K  C  A  L  K  M  D  D  F
1321 CAAACAATCACTAGTAAAAGTACTAAAAACTCCAAAATGTGCACTAAAAATGGATGATTT
 132  E  C  V  T  P  K  L  E  H  F  G  I  S  E  Y  T  M  C  L  N
1381 TGAGTGTGTAACTCCTAAATTAGAACACTTTGGTATCTCTGAATATACTATGTGTTTAAA
 152  E  D  Y  T  M  G  L  K  N  A  R  N  N  K  S  E  E  A  I  D
```

```
1441 TGAAGATTACACAATGGGACTTAAAAATGCGAGGAATAATAAAAGTGAGGAGGCCATAGA
 172   *   E   S   R   L   N   D   N   V   F   A   T   P   S   I   I   Q   Q   L
1501 TACAGAATCCAGGCTCAATGATAATGTTTTTGCCACTCCCAGCCCCATCATCCAGCAGTT
 192   E   K   S   D   A   E   Y   T   N   S   P   L   V   P   T   F   C   T   P   G
1561 GGAAAAAAGTGATGCCGAATATACCAACTCTCCTTTGGTACCTACATTCTGTACTCCTGG
 212   L   K   I   P   S   T   K   N   S   I   A   L   V   S   T   N   Y   P   L   S
1621 TTTGAAAATTCCATCTACAAGAACAGCATAGCTTTGGTATCCACAAATTACCCATTATC
 232   K   T   N   S   S   N   D   L   E   V   E   D   R   T   S   L   V   L   N
1681 AAAAACAAATAGTTCATCAAATGATTTGGAAGTTGAAGATCGTACTTCGTTGGTTTTAAA
 252   S   D   T   C   F   E   N   L   T   D   P   S   S   P   T   I   S   S   Y   E
1741 TTCAGACACATGCTTTGAGAATTTAACAGATCCCTCTTCACCTACGATTCTTCTTATGA
 272   N   L   R   T   P   T   P   P   E   V   T   K   I   P   E   D   I   L   Q
1801 GAATCTGCTCAGAACACCTACACCTCCAGAAGTAACTAAAATTCCAGAAGATATTCTCCA
 292   K   F   Q   W   I   Y   P   T   Q   K   L   N   K   M   R   *
1861 GAAATTCCAGTGGATCTATCCAACACAGAAACTGAACAAAATGAGATGAaagccgagctg
1921 gaccgattttaacattcacattgccctgcctctgtcccctttaaacgttgacccatttt
1981 aaagacaaacatgaacattaacatcataatatgctttttatgaagtttcaataaggttta
2041 accttagtcttgttgacatgtagcccagtcattcactctttaaggactattagtgtttca
2101 ttgatactaaattacccagcttaatcaacagaatggtttaagtagtaccaggaagtagga
2161 caagtaatttcaaaaatataaaggtgtttgctactcagatgaggccgcccctgaccttct
2221 ggccagagagacattgctgccagccagctctgccttccatcatctcctttcaggaccgt
2281 cccacaccttttacttgctcagtgctgtctgaagatgcagttgctgtttgcaaacaacag
2341 gaacaccagttaaactaattaggaaacagagggagatttccaggcctgggtaactatata
2401 ctgtgaccattggcggttgagaccggtcttcaaccagtggaacccgaactctgctgtca
2461 gggtgtggacttcggtgctcttccaagttttcacctggggggggagctaaccccctatg
2521 ttcacgccttctattcccattggcgctgaactcttaaggtcactctggtcgcttgtgacc
2581 ccgtaaccctgatgtaccctctaaaggtgaggggc
```

Figure 2F. The cDNA (SEQ ID. NO. :1316) and amino acid sequence (SEQ ID. NO. :1317) of 193P1E1B v.6. The start methionine is underlined. The open reading frame extends from nucleic acid 805-1026 including the stop codon.

```
   1 tatcatctgtgactgaggaaatccctatcttcctatcagactaatgaaaccacaggacag
  61 caattagacttttaagtattggggggtttagagctctagatattcgatatgcagactact
 121 catgtttgtttgttttaataaagactggtccaaaggctcattttcacacaagctacagtt
 181 tttcagttccaggaccaggtaaagatggtcagctccgtgatccataaaatccaagggtga
 241 cgactcaggattaggaccatttcttggtgacattgagatggtcgagctggtccgcaatga
 301 atctatgcggggggaacttggaagtggcggccgcctttatggcctcgaaggcctccctcc
 361 tgcgcaccgcggcgtggccgcgctcctgctcccgggtcatgtagggcatgctcagccagt
 421 aatggttctccgcctcgatctccaggcggcggatcatgttctgcttggcgcgcaacgaca
 481 cgaaccgcggccgccggtgcttcccgatccactgacggccgggaatgcggccgcgccaga
 541 ggagcgcagtcaggaacatggtgcctgccgcgctgctcaagactctgcgtctccgcggcc
 601 gccagcagacgccgtggcgtaagcgcacccgtctcgcggggtctccgggggcctcggcga
 661 gagacttcggctctcgcgagagaggactgcgcctgcgcagagccgaggacgcgtccggcg
 721 ccgagattcaaactagtggcgggaggctgtgagctgagcggtggggtctgcgtacgcctg 1                                 M  D  P  I  R  S  F  C  G  K  L  R
 781 gagtccttccccgctgtgctcagcATGGACCCTATCCGGAGCTTCTGCGGGAAGCTGCGG
  13  S  L  A  S  T  L  D  C  E  T  A  R  L  Q  R  A  L  D  G  E
 841 TCTCTGGCCAGCACGCTGGACTGCGAGACGGCCCGGCTGCAGCGAGCGCTGGACGGAGAG
  33  E  S  L  L  S  K  Y  N  S  N  L  A  T  P  I  A  I  K  A  V
 901 GAAAGCCTTTTATCAAAATACAACTCAAACCTAGCTACTCCAATAGCAATTAAAGCAGTG
  53  P  P  S  K  R  F  L  K  H  G  Q  N  I  R  D  V  S  N  K  E
 961 CCACCCAGTAAAAGGTTCCTTAAACATGGACAGAACATCCGAGATGTCAGCAACAAAGAA
  73  N  *
1021 AACTGAaattccagtggatctatccaacacagaaactgaacaaaatgagatgaaagccga
1081 gctggaccgattttaacattcacattgccctgcctctgtccccctttaaacgttgaccca
1141 ttttaaagacaaacatgaacattaacatcataatatgcttttatgaagtttcaataagg
1201 tttaaccttagtcttgttgacatgtagcccagtcattcactctttaaggactattagtgt
1261 ttcattgatactaaattacccagcttaatcaacagaatggtttaagtagtaccaggaagt
1321 aggacaagtaatttcaaaaatataaaggtgtttgctactcagatgaggccgcccctgacc
1381 ttctggccagagagacattgctgccagccagctctgccttcccatcatctcctttcagga
1441 ccgtcccacacctttttacttgctcagtgctgtctgaagatgcagttgctgtttgcaaaca
1501 acaggaacaccagttaaactaattaggaaacagagggagatttccaggcctgggtaacta
1561 tatactgtgaccattggcggttgagaccggtcttcaaccagtggaaccccgaactctgct
1621 gtcagggtgtggacttcggtgctcttccaagttttcacctgggggggggagctaacccc
```

```
1681 tatgttcacgccttctattcccattggcgctgaactcttaaggtcactctggtcgcttgt
1741 gaccccgtaaccctgatgtaccctctaaaaggtgaggggc
```

Figure 3:

Figure 3A. Amino acid sequence of 193P1E1B v.1 (SEQ ID. NO. :2983). The 193P1E1B v.1 protein has 412 amino acids.

```
  1 MDPIRSFCGK LRSLASTLDC ETARLQRALD GEESDFEDYP MRILYDLHSE VQTLKDDVNI
 61 LLDKARLENQ EGIDFIKATK VLMEKNSMDI MKIREYFQKY GYSPRVKKNS VHEQEAINSD
121 PELSNCENFQ KTDVKDDLSD PPVASSCISE KSPRSPQLSD FGLERYIVSQ VLPNPPQAVN
181 NYKEEPVIVT PPTKQSLVKV LKTPKCALKM DDFECVTPKL EHFGISEYTM CLNEDYTMGL
241 KNARNNKSEE AIDTESRLND NVFATPSPII QQLEKSDAEY TNSPLVPTFC TPGLKIPSTK
301 NSIALVSTNY PLSKTNSSSN DLEVEDRTSL VLNSDTCFEN LTDPSSPTIS SYENLLRTPT
361 PPEVTKIPED ILQLLSKYNS NLATPIAIKA VPPSKRFLKH GQNIRDVSNK EN*
```

Figure 3B. Amino acid sequence of 193P1E1B v.2 (SEQ ID. NO. :2985). The 193P1E1B v.2 protein has 412 amino acids.

```
  1 MDPIRSFCGK LRSLASTLDC ETARLQRALD GEESDFEDYP MRILYDLHSE VQTLKDDVNI
 61 LLDKARLENQ EGIDFIKATK VLMEKNSMDI MKIREYFQKY GYSPRVKKNS VHEQEAINSD
121 PELSNCENFQ KTDVKDDLSD PPVASSCISG KSPRSPQLSD FGLERYIVSQ VLPNPPQAVN
181 NYKEEPVIVT PPTKQSLVKV LKTPKCALKM DDFECVTPKL EHFGISEYTM CLNEDYTMGL
241 KNARNNKSEE AIDTESRLND NVFATPSPII QQLEKSDAEY TNSPLVPTFC TPGLKIPSTK
301 NSIALVSTNY PLSKTNSSSN DLEVEDRTSL VLNSDTCFEN LTDPSSPTIS SYENLLRTPT
361 PPEVTKIPED ILQLLSKYNS NLATPIAIKA VPPSKRFLKH GQNIRDVSNK EN*
```

Figure 3C. Amino acid sequence of 193P1E1B v.3 (SEQ ID. NO. :1310). The 193P1E1B v.3 protein has 330 amino acids.

```
  1 MEKNSMDIMK IREYFQKYGY SPRVKKNSVH EQEAINSDPE LSNCENFQKT DVKDDLSDPP
 61 VASSCISEKS PRSPQLSDFG LERYIVSQVL PNPPQAVNNY KEEPVIVTPP TKQSLVKVLK
121 TPKCALKMDD FECVTPKLEH FGISEYTMCL NEDYTMGLKN ARNNKSEEAI DAESRLNDNV
181 FATPSPIIQQ LEKSDAEYTN SPLVPTFCTP GLKIPSTKNS IALVSTNYPL SKTNSSSNDL
241 EVEDRTSLVL NSDTCFENLT DPSSPTISSY ENLLRTPTPP EVTKIPEDIL QLLSKYNSNL
301 ATPIAIKAVP PSKRFLKHGQ NIRDVSNKEN *
```

Figure 3D. Amino acid sequence of 193P1E1B v.4 (SEQ ID. NO. :1313). The 193P1E1B v.4 protein has 388 amino acids.

```
  1 MDPIRSFCGK LRSLASTLDC ETARLQRALD GEESDFEDYP MRILYDLHSE VQTLKDDVNI
 61 LLDKARLENQ EGIDFIKATK VLMEKNSMDI MKIREYFQKY GYSPRVKKNS VHEQEAINSD
121 PELSNCENFQ KTDVKDDLSD PPVASSCISE KSPRSPQLSD FGLERYIVSQ VLPNPPQAVN
181 NYKEEPVIVT PPTKQSLVKV LKTPKCALKM DDFECVTPKL EHFGISEYTM CLNEDYTMGL
241 KNARNNKSEE AIDTESRLND NVFATPSPII QQLEKSDAEY TNSPLVPTFC TPGLKIPSTK
301 NSIALVSTNY PLSKTNSSSN DLEVEDRTSL VLNSDTCFEN LTDPSSPTIS SYENLLRTPT
361 PPEVTKIPED ILQKFQWIYP TQKLNKMR*
```

Figure 3E. Amino acid sequence of 193P1E1B v.5 (SEQ ID. NO. :1315). The 193P1E1B v.5 protein has 306 amino acids.

```
  1 MEKNSMDIMK IREYFQKYGY SPRVKKNSVH EQEAINSDPE LSNCENFQKT DVKDDLSDPP
 61 VASSCISEKS PRSPQLSDFG LERYIVSQVL PNPPQAVNNY KEEPVIVTPP TKQSLVKVLK
121 TPKCALKMDD FECVTPKLEH FGISEYTMCL NEDYTMGLKN ARNNKSEEAI DTESRLNDNV
181 FATPSPIIQQ LEKSDAEYTN SPLVPTFCTP GLKIPSTKNS IALVSTNYPL SKTNSSSNDL
241 EVEDRTSLVL NSDTCFENLT DPSSPTISSY ENLLRTPTPP EVTKIPEDIL QKFQWIYPTQ
301 KLNKMR*
```

Figure 3F. Amino acid sequence of 193P1E1B v.6 (SEQ ID. NO. :1317). The 193P1E1B v.6 protein has 73 amino acids.

```
  1 MDPIRSFCGK LRSLASTLDC ETARLQRALD GEESLLSKYN SNLATPIAIK AVPPSKRFLK
 61 HGQNIRDVSN KEN*
```

Figure 4:

Figure 4: Amino Acid Alignments of the 6 variants of 193P1E1B.

(SEQ ID NOS 2983,2985, 1310, 1313, 1315 & 1317, respectively, in order of appearance)

```
              1                                                    50
193P1E1B_v.1  MDPIRSFCGK LRSLASTLDC ETARLQRALD GEESDFEDYP MRILYDLHSE
193P1E1B_v.2  MDPIRSFCGK LRSLASTLDC ETARLQRALD GEESDFEDYP MRILYDLHSE
193P1E1B_v.3  .......... .......... .......... .......... ..........
193P1E1B_v.4  MDPIRSFCGK LRSLASTLDC ETARLQRALD GEESDFEDYP MRILYDLHSE
193P1E1B_v.5  .......... .......... .......... .......... ..........
193P1E1B_v.6  MDPIRSFCGK LRSLASTLDC ETARLQRALD GEES...... ..........

51                                                   100
193P1E1B_v.1  VQTLKDDVNI LLDKARLENQ EGIDFIKATK VLMEKNSMDI MKIREYFQKY
193P1E1B_v.2  VQTLKDDVNI LLDKARLENQ EGIDFIKATK VLMEKNSMDI MKIREYFQKY
193P1E1B_v.3  .......... .......... .......... ..MEKNSMDI MKIREYFQKY
193P1E1B_v.4  VQTLKDDVNI LLDKARLENQ EGIDFIKATK VLMEKNSMDI MKIREYFQKY
193P1E1B_v.5  .......... .......... .......... ..MEKNSMDI MKIREYFQKY
193P1E1B_v.6  .......... .......... .......... .......... ..........

101                                                  150
193P1E1B_v.1  GYSPRVKKNS VHEQEAINSD PELSNCENFQ KTDVKDDLSD PPVASSCISE
193P1E1B_v.2  GYSPRVKKNS VHEQEAINSD PELSNCENFQ KTDVKDDLSD PPVASSCISG
193P1E1B_v.3  GYSPRVKKNS VHEQEAINSD PELSNCENFQ KTDVKDDLSD PPVASSCISE
193P1E1B_v.4  GYSPRVKKNS VHEQEAINSD PELSNCENFQ KTDVKDDLSD PPVASSCISE
193P1E1B_v.5  GYSPRVKKNS VHEQEAINSD PELSNCENFQ KTDVKDDLSD PPVASSCISE
193P1E1B_v.6  .......... .......... .......... .......... ..........

151                                                  200
193P1E1B_v.1  KSPRSPQLSD FGLERYIVSQ VLPNPPQAVN NYKEEPVIVT PPTKQSLVKV
193P1E1B_v.2  KSPRSPQLSD FGLERYIVSQ VLPNPPQAVN NYKEEPVIVT PPTKQSLVKV
193P1E1B_v.3  KSPRSPQLSD FGLERYIVSQ VLPNPPQAVN NYKEEPVIVT PPTKQSLVKV
193P1E1B_v.4  KSPRSPQLSD FGLERYIVSQ VLPNPPQAVN NYKEEPVIVT PPTKQSLVKV
193P1E1B_v.5  KSPRSPQLSD FGLERYIVSQ VLPNPPQAVN NYKEEPVIVT PPTKQSLVKV
193P1E1B_v.6  .......... .......... .......... .......... ..........

201                                                  250
193P1E1B_v.1  LKTPKCALKM DDFECVTPKL EHFGISEYTM CLNEDYTMGL KNARNNKSEE
193P1E1B_v.2  LKTPKCALKM DDFECVTPKL EHFGISEYTM CLNEDYTMGL KNARNNKSEE
193P1E1B_v.3  LKTPKCALKM DDFECVTPKL EHFGISEYTM CLNEDYTMGL KNARNNKSEE
193P1E1B_v..4 LKTPKCALKM DDFECVTPKL EHFGISEYTM CLNEDYTMGL KNARNNKSEE
193P1E1B_v.5  LKTPKCALKM DDFECVTPKL EHFGISEYTM CLNEDYTMGL KNARNNKSEE
193P1E1B_v.6  .......... .......... .......... .......... ..........

251                                                  300
193P1E1B_v.1  AIDTESRLND NVFATPSPII QQLEKSDAEY TNSPLVPTFC TPGLKIPSTK
193P1E1B_v.2  AIDTESRLND NVFATPSPII QQLEKSDAEY TNSPLVPTFC TPGLKIPSTK
193P1E1B_v.3  AIDAESRLND NVFATPSPII QQLEKSDAEY TNSPLVPTFC TPGLKIPSTK
193P1E1B_v.4  AIDTESRLND NVFATPSPII QQLEKSDAEY TNSPLVPTFC TPGLKIPSTK
193P1E1B_v.5  AIDTESRLND NVFATPSPII QQLEKSDAEY TNSPLVPTFC TPGLKIPSTK
193P1E1B_v.6  .......... .......... .......... .......... ..........

301                                                  350
193P1E1B_v.1  NSIALVSTNY PLSKTNSSSN DLEVEDRTSL VLNSDTCFEN LTDPSSPTIS
193P1E1B_v.2  NSIALVSTNY PLSKTNSSSN DLEVEDRTSL VLNSDTCFEN LTDPSSPTIS
193P1E1B_v.3  NSIALVSTNY PLSKTNSSSN DLEVEDRTSL VLNSDTCFEN LTDPSSPTIS
193P1E1B_v.4  NSIALVSTNY PLSKTNSSSN DLEVEDRTSL VLNSDTCFEN LTDPSSPTIS
193P1E1B_v.5  NSIALVSTNY PLSKTNSSSN DLEVEDRTSL VLNSDTCFEN LTDPSSPTIS
193P1E1B_v.6  .......... .......... .......... .......... ..........
```

```
             351                                                  400
193P1E1B_v.1 SYENLLRTPT PPEVTKIPED ILQLLSKYNS NLATPIAIKA VPPSKRFLKH
193P1E1B_v.2 SYENLLRTPT PPEVTKIPED ILQLLSKYNS NLATPIAIKA VPPSKRFLKH
193P1E1B_v.3 SYENLLRTPT PPEVTKIPED ILQLLSKYNS NLATPIAIKA VPPSKRFLKH
193P1E1B_v.4 SYENLLRTPT PPEVTKIPED ILQ....... .......... ..........
193P1E1B_v.5 SYENLLRTPT PPEVTKIPED ILQ....... .......... ..........
193P1E1B_v.6 .......... .......... ...LLSKYNS NLATPIAIKA VPPSKRFLKH 401        412
193P1E1B_v.1 GQNIRDVSNK EN........ ........
193P1E1B_v.2 GQNIRDVSNK EN........ ........
193P1E1B_v.3 GQNIRDVSNK EN........ ........
193P1E1B_v.4 .......... ..KFQWIYPT QKLNKMR
193P1E1B_v.5 .......... ..KFQWIYPT QKLNKMR
193P1E1B_v.6 GQNIRDVSNK EN........ ........
```

Figure 5: 193P1E1B Hydrophilicity profile
(Hopp T.P., Woods K.R., 1981. Proc. Natl. Acad. Sci. U.S.A. 78:3824-3828)
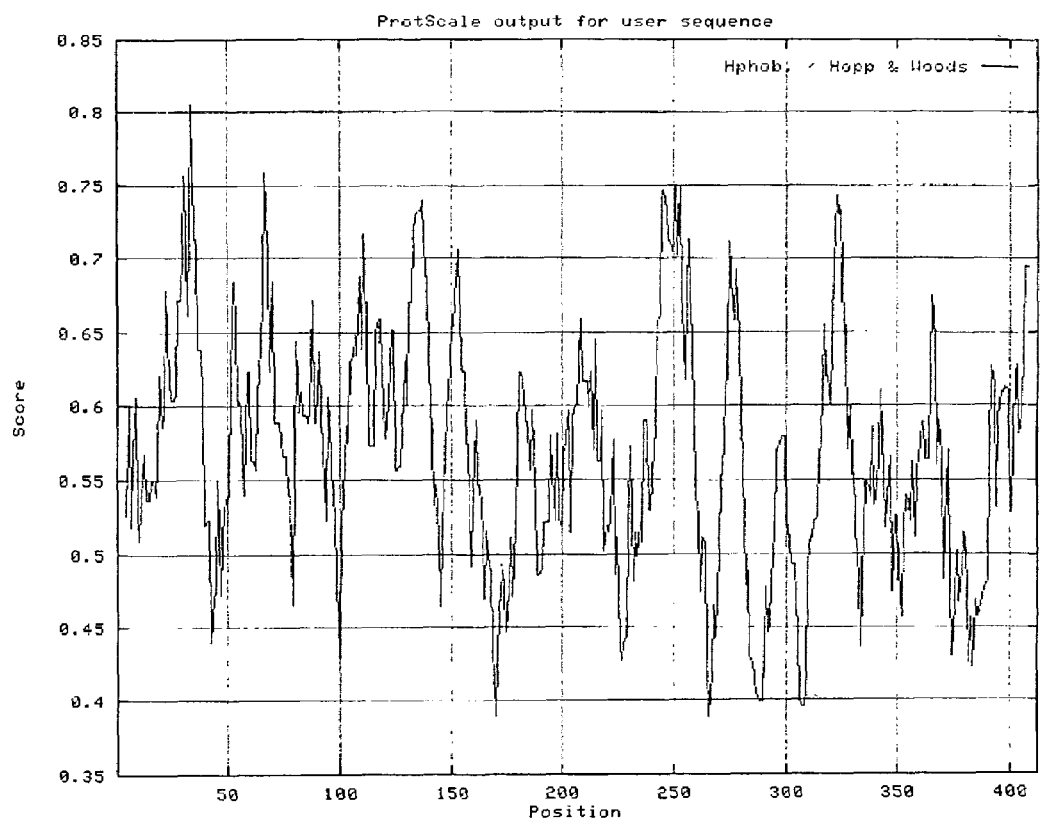

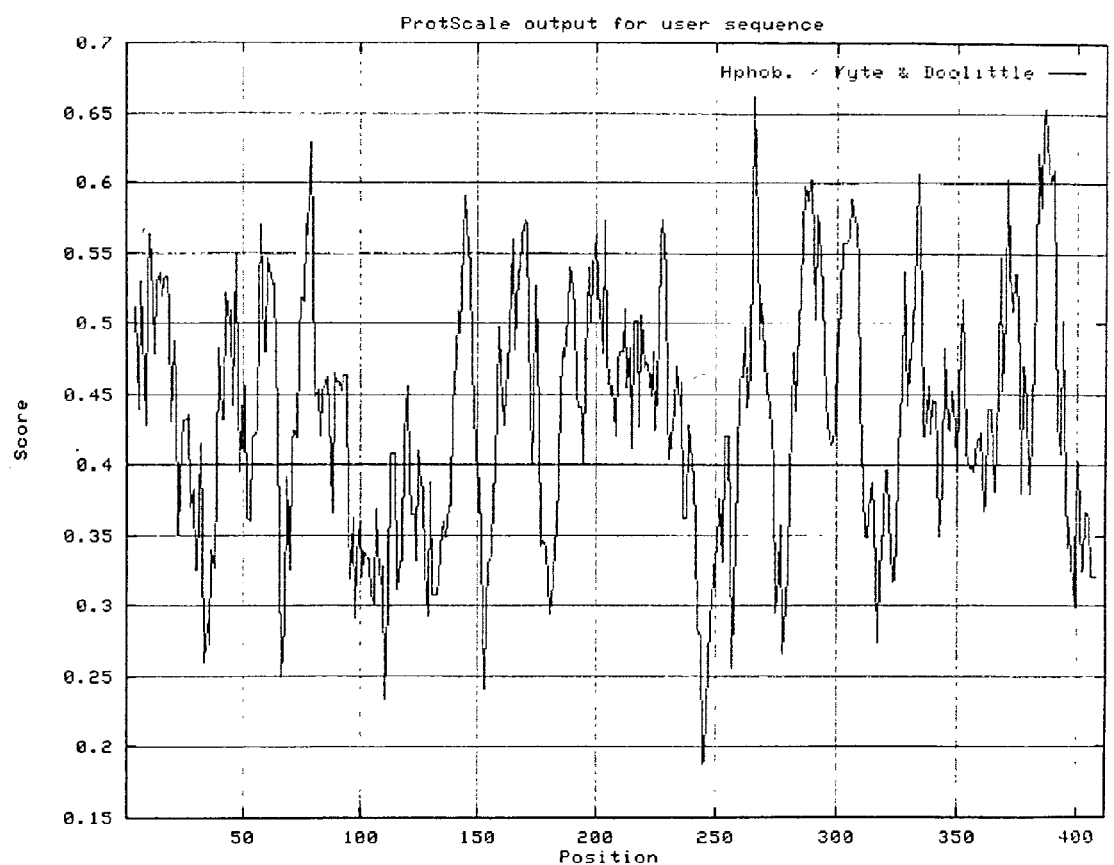
Figure 6: 193P1E1B Hydropathicity Profile
(Kyte J., Doolittle R.F., 1982. J. Mol. Biol. 157:105-132)

Figure 7: 193P1E1B % Accessible Residues Profile
(Janin J., 1979. Nature 277:491-492)
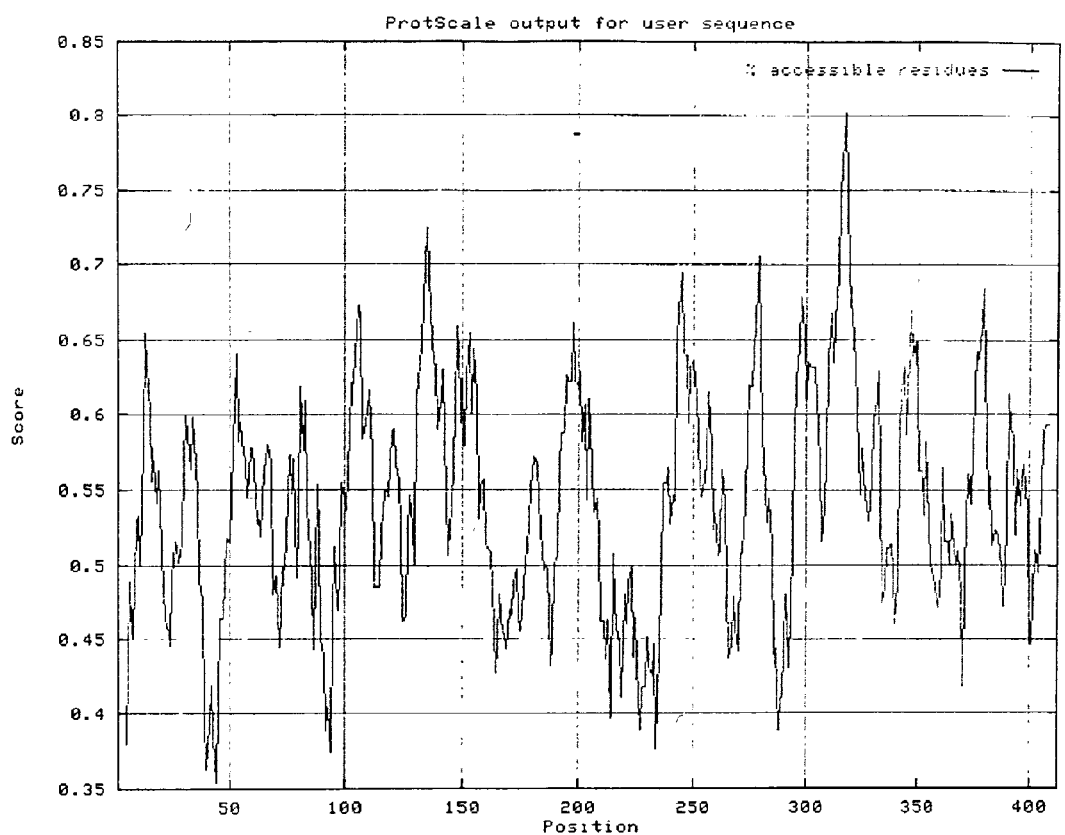

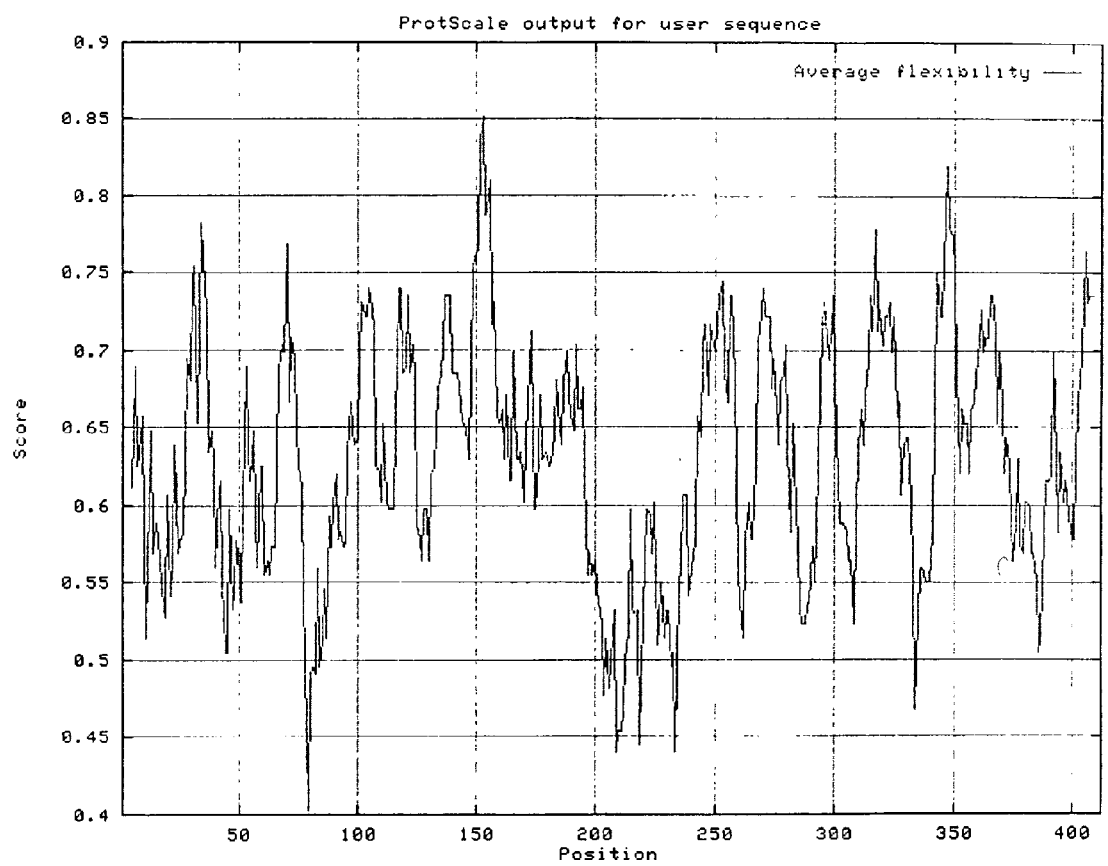
Figure 8: 193P1E1B Average Flexibility Profile
(Bhaskaran R., Ponnuswamy P.K., 1988.
Int. J. Pept. Protein Res. 32:242-255)

Figure 9: 193P1E1B Beta-turn Profile
(Deleage, G., Roux B. 1987. Protein Engineering 1:289-294)
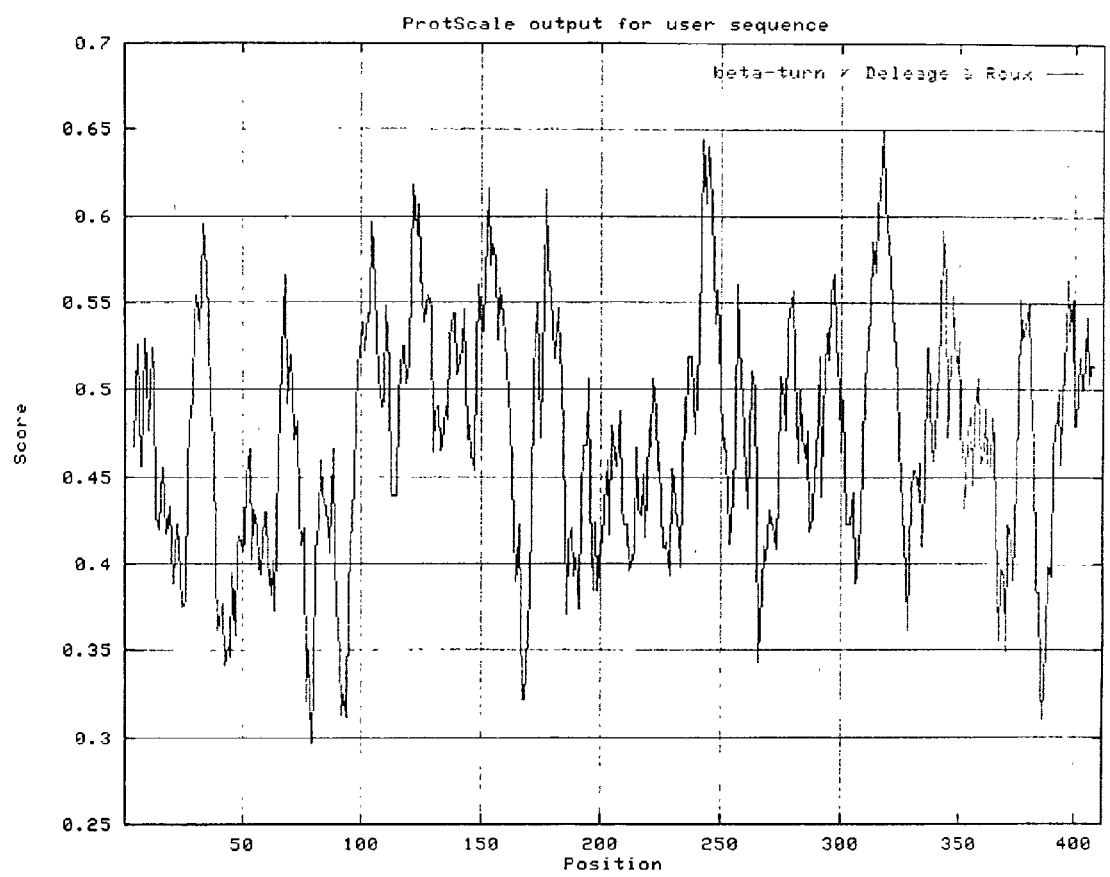

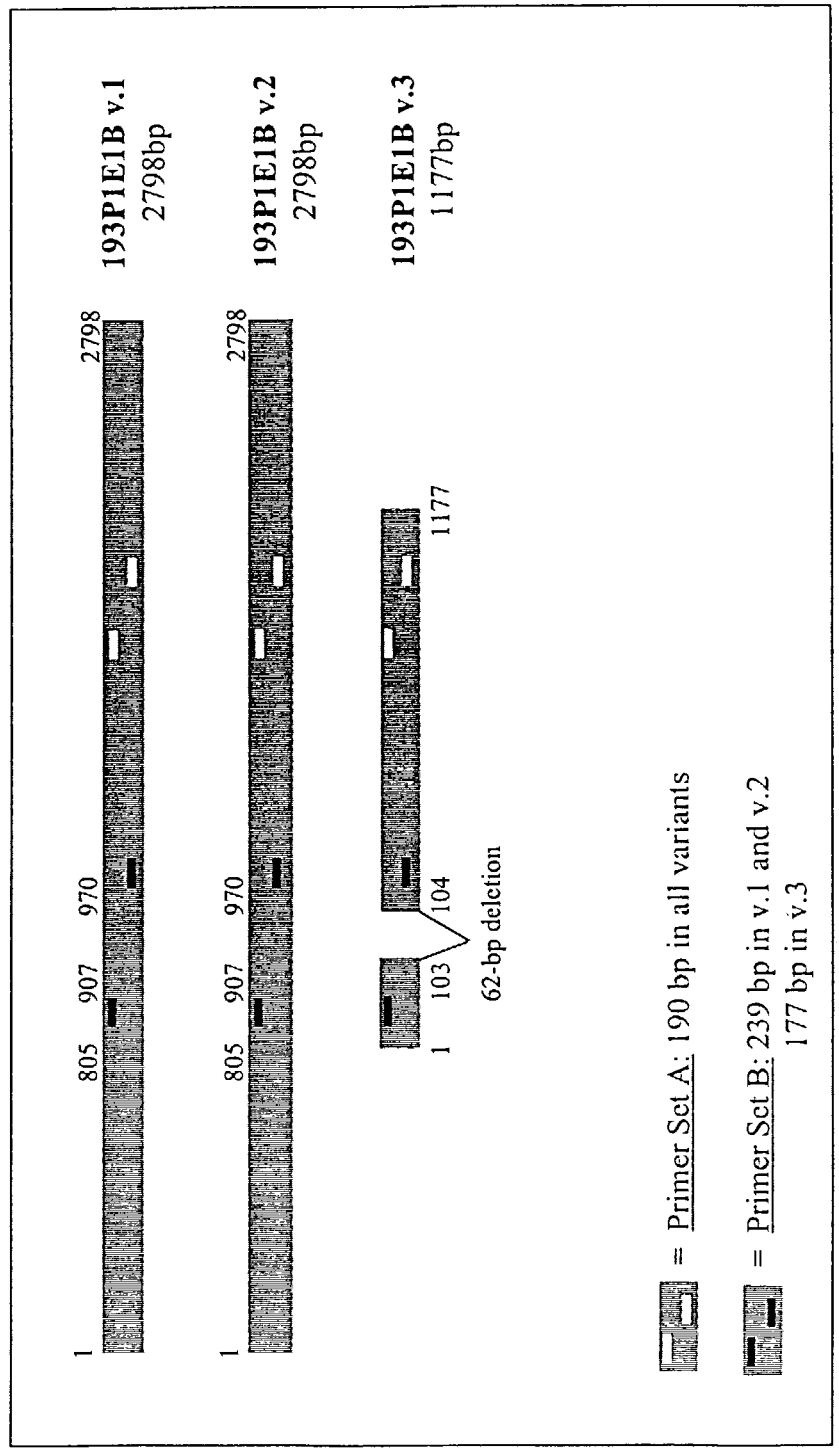
Figure 10A Schematic Diagram Depicting Location of the PCR primers

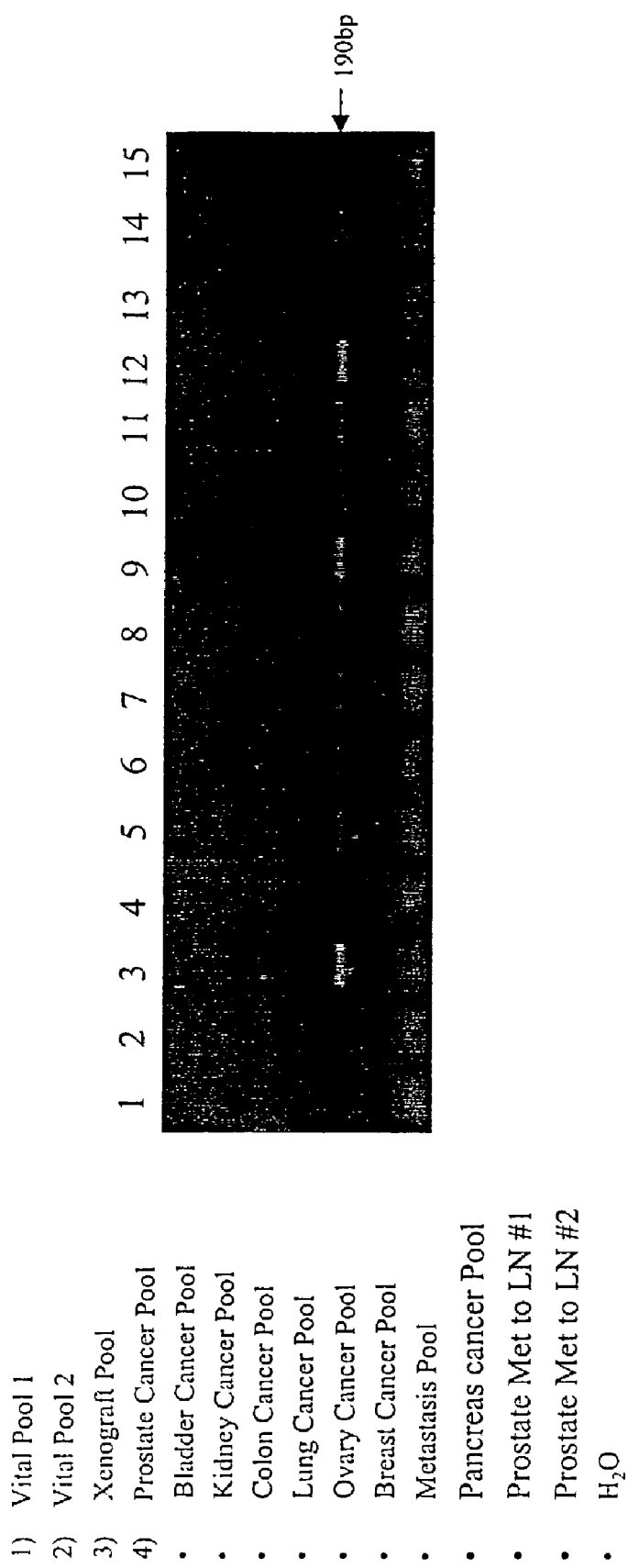
Figure 10B Expression of 193P1E1B by RT-PCR using Primer Set A
1) Vital Pool 1
2) Vital Pool 2
3) Xenograft Pool
4) Prostate Cancer Pool
• Bladder Cancer Pool
• Kidney Cancer Pool
• Colon Cancer Pool
• Lung Cancer Pool
• Ovary Cancer Pool
• Breast Cancer Pool
• Metastasis Pool
• Pancreas cancer Pool
• Prostate Met to LN #1
• Prostate Met to LN #2
• $H_2O$

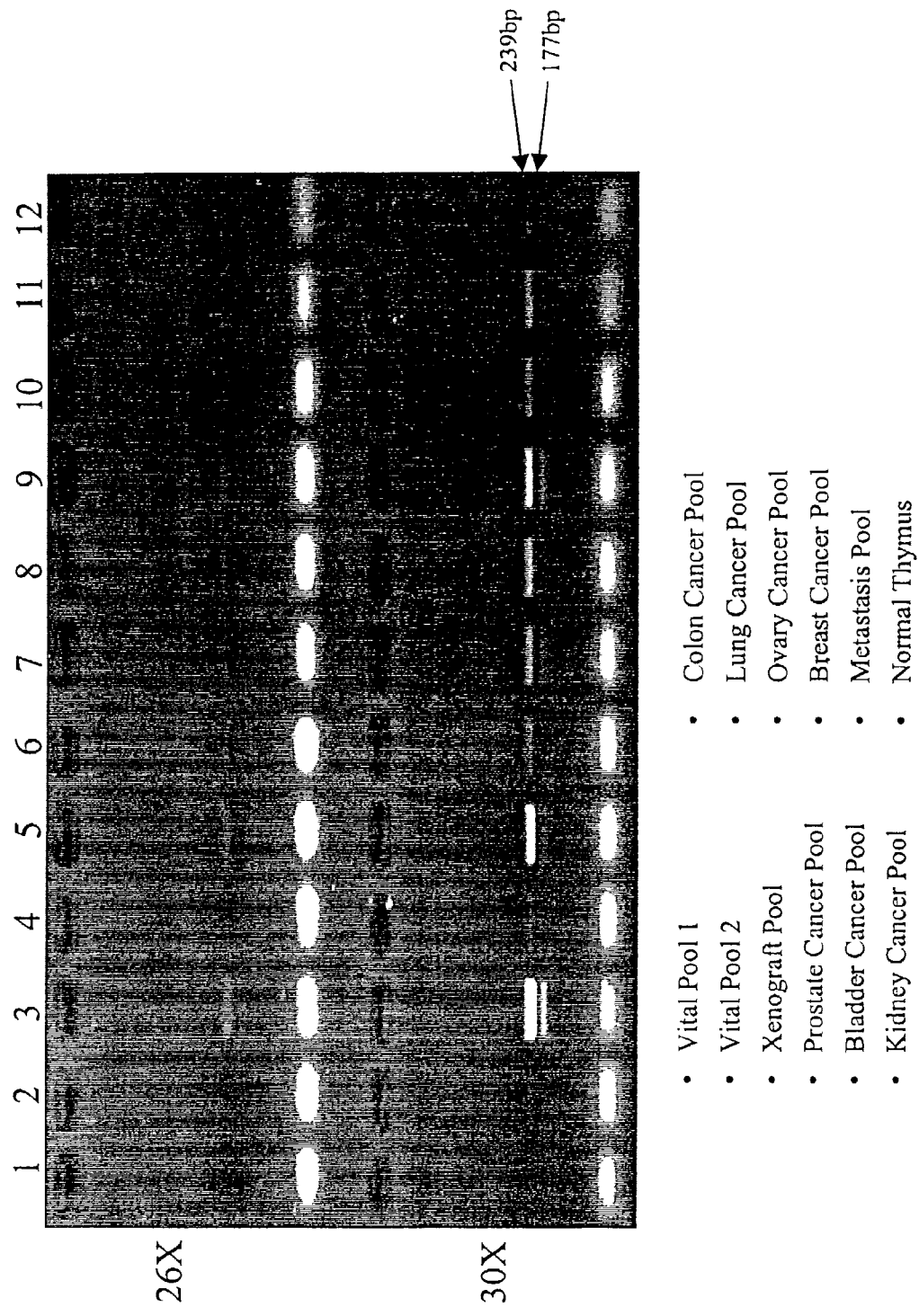
Figure 10C Expression of 193P1E1B by RT-PCR using Primer Set B

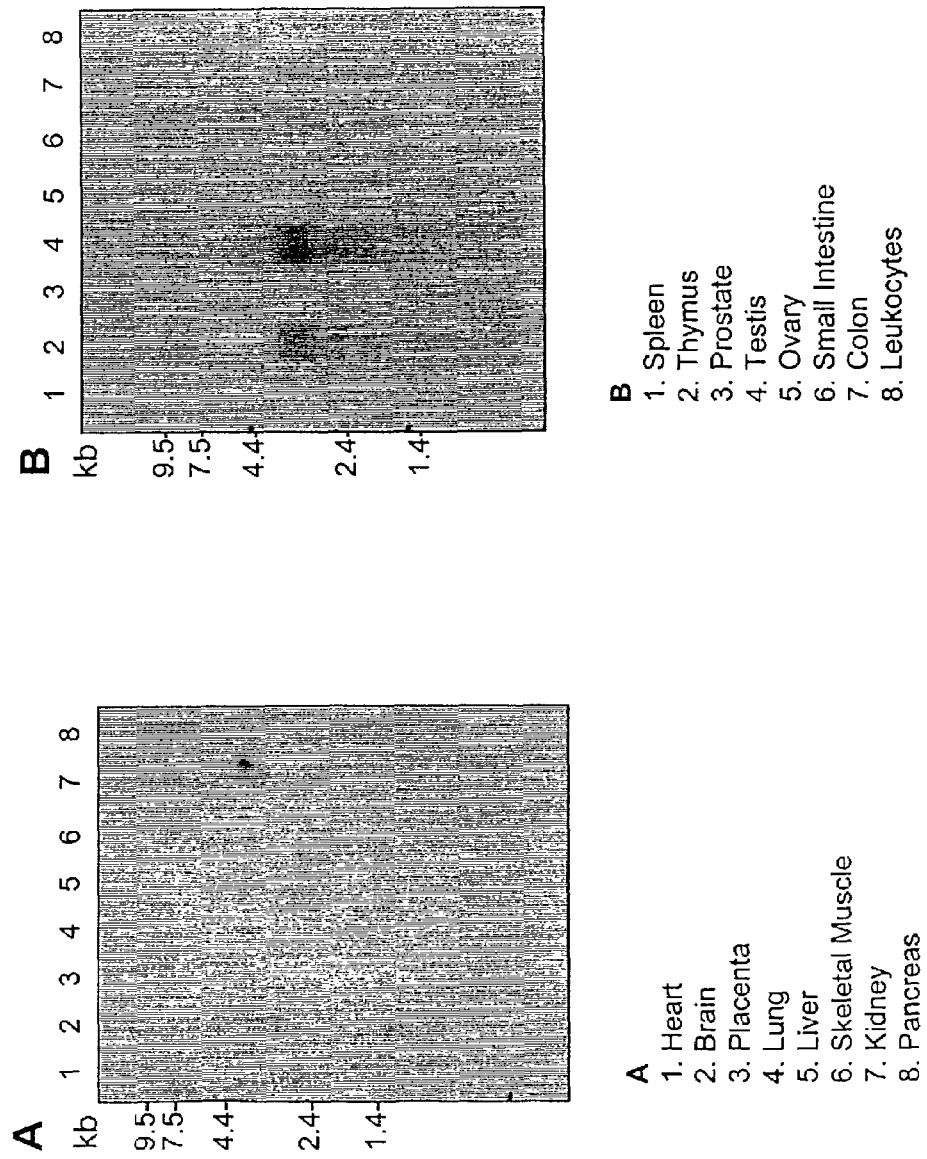
Figure 11 Expression of 193P1E1B in Normal Tissues

Figure 12   Expression of 193P1E1B in Prostate Cancer Xenografts
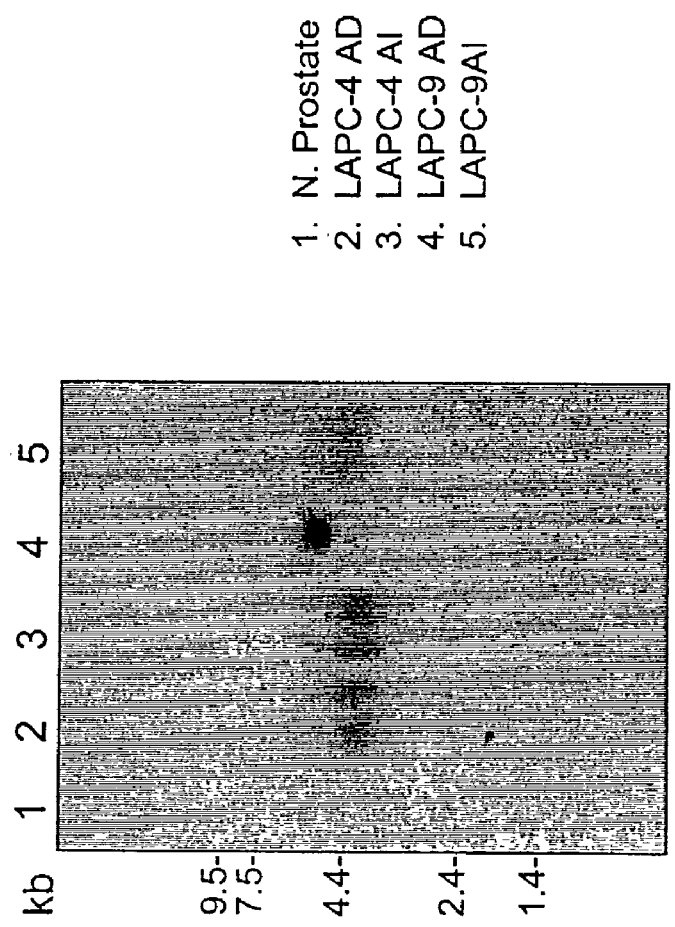

Figure 13 Expression of 193P1E1B in Human Patient Cancer Specimens
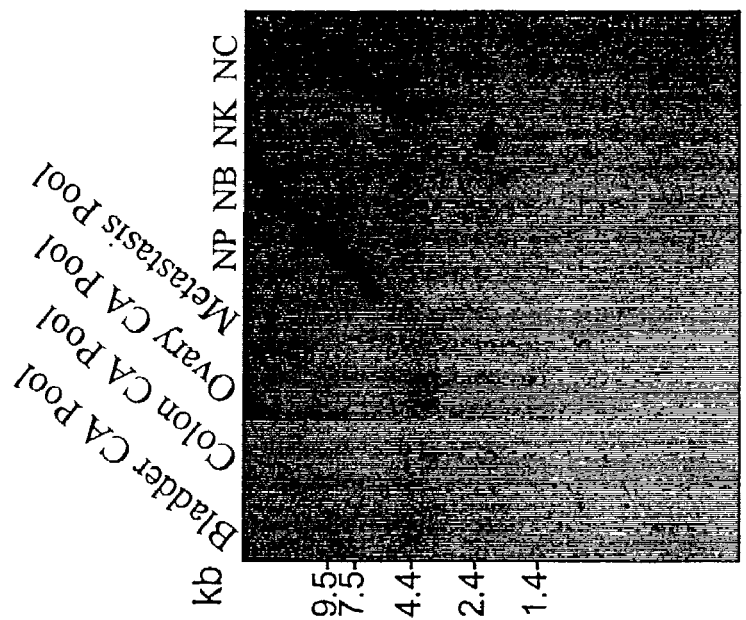
10μg total RNA/per lane from a pool of 3 tumors as follows:
*Bladder Cancer Pool = grade 2, 3*
*Colon Cancer Pool = stage II, III, IV*
*Ovary Cancer Pool = grade 2, 2, 3*
*Metastasis Pool = colon to lung, colon to liver, ovary to fall. tube*
NP = Normal Prostate
NB = Normal Bladder
NK = Normal Kidney
NC = Normal Colon

Figure 14 Expression of 193P1E1B in Bladder Cancer Patient Specimens
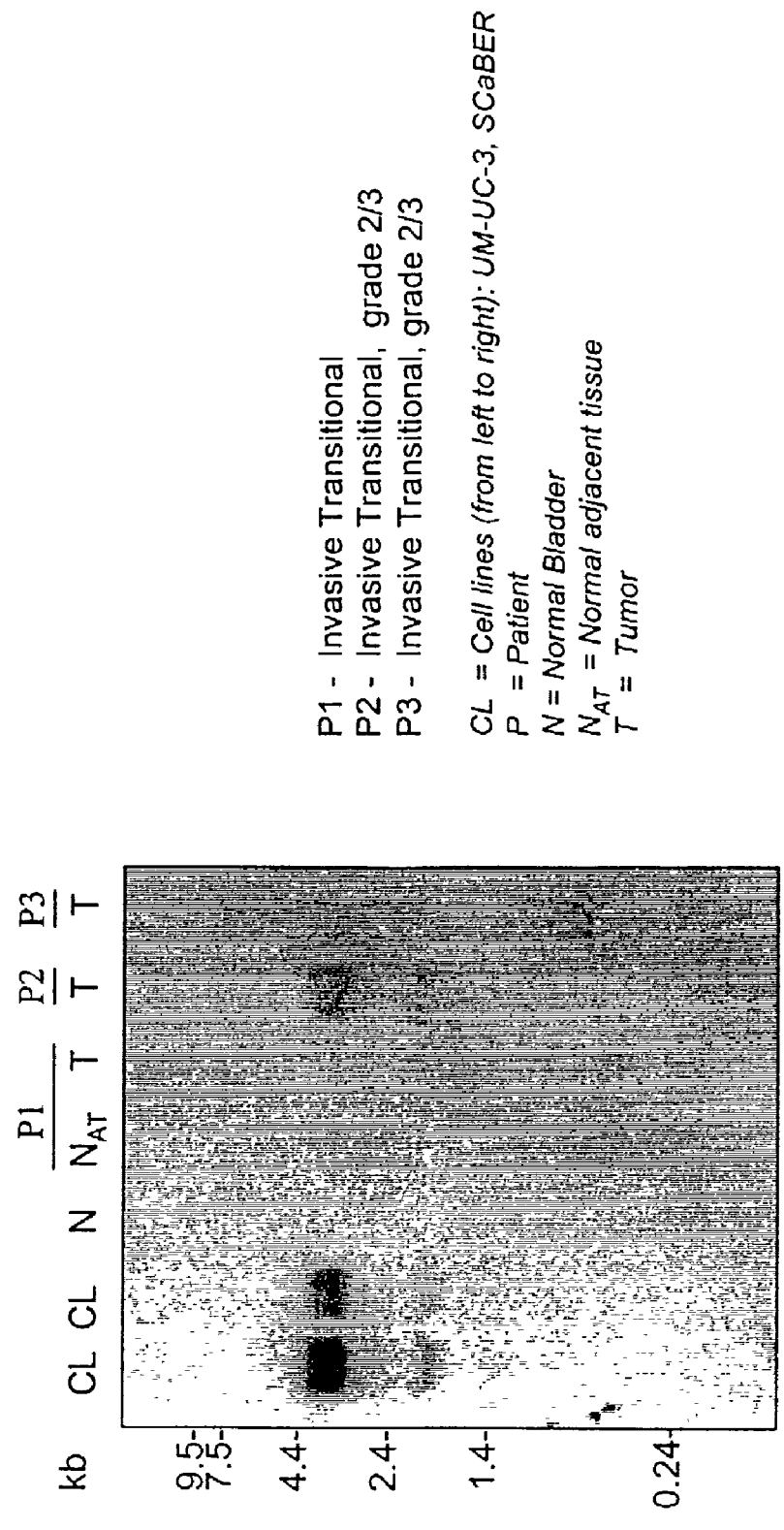
P1 - Invasive Transitional
P2 - Invasive Transitional, grade 2/3
P3 - Invasive Transitional, grade 2/3
CL = Cell lines (from left to right): UM-UC-3, SCaBER
P = Patient
N = Normal Bladder
$N_{AT}$ = Normal adjacent tissue
T = Tumor

Figure 15  Expression of 193P1E1B in Cancer Metastasis Patient Specimens
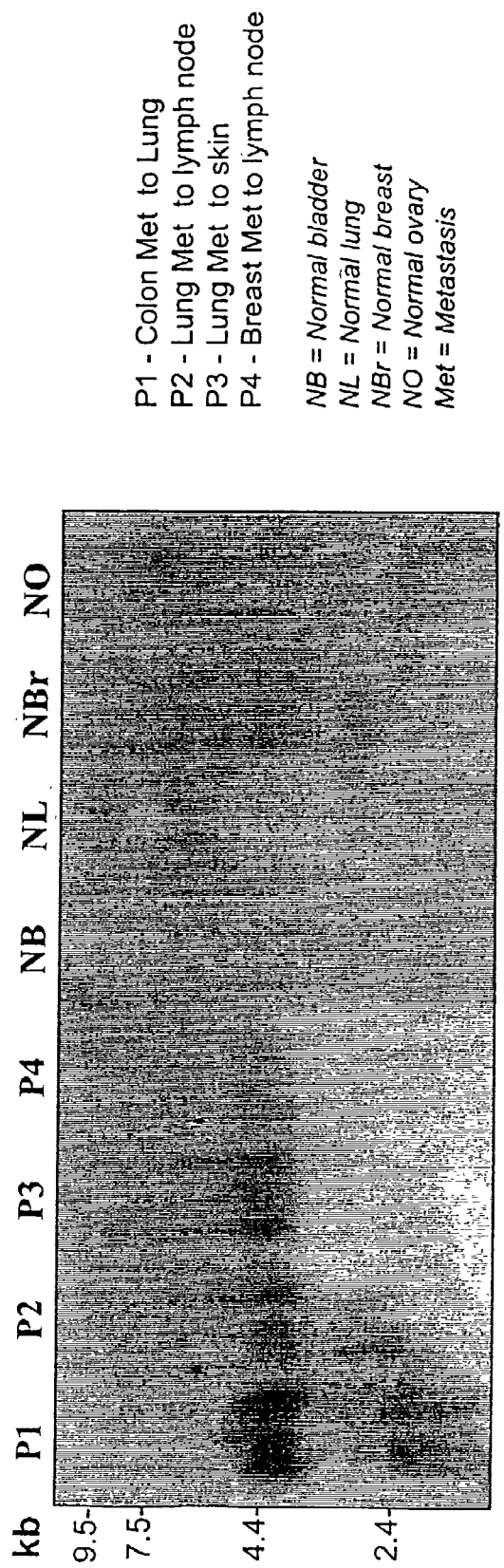

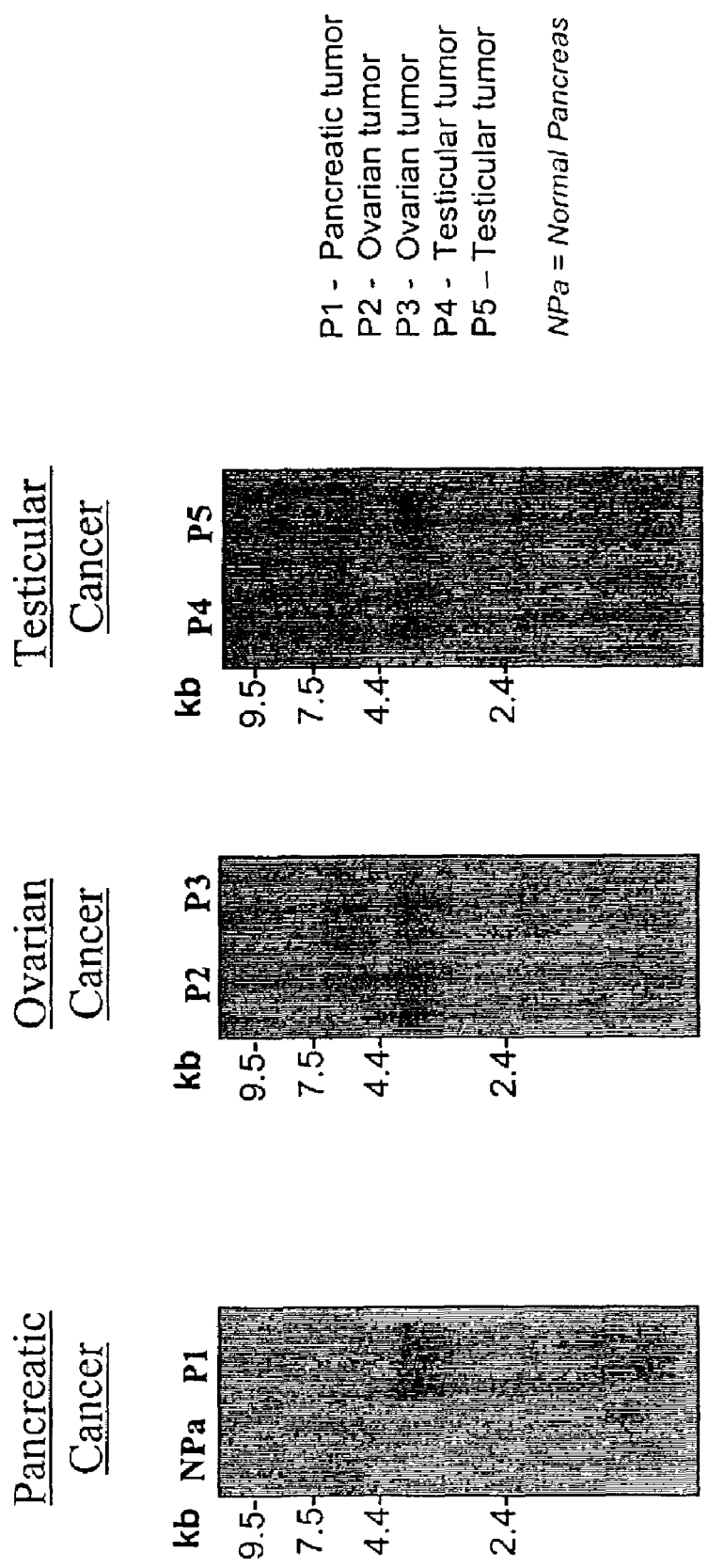
Figure 16 Expression of 193P1E1B in Pancreas, Ovary and Testis Cancer Patient Specimens

Figure 17: 193P1E1B secondary structure

```
         10        20        30        40        50        60        70
          |         |         |         |         |         |         |
MDPIRSFCGKLRSLASTLDCETARLQRALDGEESDFEDYPMRILYDLHSEVQTLKDDVNILLDKARLENQ
ccchhhhhchchhhhhhchhhhhhhhhhhhhcccchhhhhhhhhhhhhhhhhhhhhhhhhhhhhhchch
EGIDFIKATKVLMEKNSMDIMKIREYFQKYGYSPRVKKNSVHEQEAINSDPELSNCENFQKTDVKDDLSD
cchhhhhhhhhhhcchhhhhhhhhhhhhhhcccccccccccccccccccccccccccccccccccccc
PPVASSCISEKSPRSPQLSDFGLERYIVSQVLPNPPQAVNNYKEEPVIVTPPTKQSLVKVLKTPKCALKM
ccccccccccccccccccccccchehhecccccccccccccccccccceeeeeccccccceeec
DDFECVTPKLEHFGISEYTMCLNEDYTMGLKNARNNKSEEAIDTESRLNDNVFATPSPIIQQLEKSDAEY
cccccccccccccccccceeeeeecccccchccccccccccccccccchhhhhccccccccccccccc
TNSPLVPTFCTPGLKIPSTKNSIALVSTNYPLSKTNSSSNDLEVEDRTSLVLNSDTCFENLTDPSSPTIS
ccccccccccccccccccccccceeeeecccccccccccccccccceeeecccccchccccccccccc
SYENLLRTPTPPEVTKIPEDILQLLSKYNSNLATPIAIKAVPPSKRFLKHGQNIRDVSNKEN
chhhccccccccccccccchhhhhhhhhhcccccceeeecccchchhccccccccccccc
``` h: Alpha helix          29.13%
c: Random coil          60.92%
e: Extended strand       9.95%

Figure 18: Blast results and alignment of 193P1E1 V.3 with DRADA (P55265)

Identities = 95/412 (23%)  Positives = 150/412 (36%), Gaps = 76/412 (18%)

(SEQ ID NO: 2987)

```
Query:  18  LDCETARLQRALDGEESDFEDYPMRIL--------------YDLHSEVQTLKDDVNILLD  63
            +DC ++  Q    E S ++D   RIL              +DL  ++ T K ++N +L
Sbjct: 123  VDCLSSHFQ-----ELSIYQDQEQRILKFLEELGEGKATTAHDLSGKLGTPKKEINRVL- 176
```

(SEQ ID NO:2988 )

```
Query:  64  KARLENQEGIDFIKATKVLMEKNSMDIMKIREYFQKYGYSPRVKKNSVHEQEAINSDPEL 123
                      K  K+  E  +  + KI     Q +     V  +  H Q A NSDP L
Sbjct: 177  ---------YSLAKKGKLQKEAGTPPLWKIAVSTQAWNQHSGVVRPDGHSQGAPNSDPSL 227

Query: 124  SNCENFQKTDVKDDLSDPPVASSCISGKSPRSPQLSDFGLERYIVSQVLPNPPQAVNNYK 183
             E+   T V +DL +P +A S  +        D        SQ  PN      +
Sbjct: 228  EP-EDRNSTSVSEDLLEPFIAVSAQAWNQHSGVVRPDSH------SQGSPNSDPGLE--- 277

Query: 184  EEPVIVTPPTKQSLVKVLKTPKCALKMDDF-ECVTPKLEHFGISEYTMCLNEDYTMGLKN 242
                  P  +      L+ P  L M +   E +      L  F +S+ +   LN   +GL
Sbjct: 278  --------PEDSNTSALEDPLEFLDMAEIKEKICDYL--FNVSD-SSALNLAKNIGLTK 326

Query: 243  ARNNKSEEAIDAESRLNDNVFATPSPIIQQLEKSDAEY---TNSPLVPTFCTPGLKIPST 299
            AR+   +  ID E + +   T  PI   +K        N+  VP   T      IP T
Sbjct: 327  ARDINA-VLIDMERQGDVYRQGTTPPIWHLTDKKRERMQIKRNTNSVPE--TAPAAIPET 383

Query: 300  KNSIALVSTNYPLSK-TNSSSNDLEVEDRTSLVLNSDTCFENLTDP---------SSPTI 349
            K +    ++ N P S  +N+      +VE+  V  +    E  +P            + P+
Sbjct: 384  KRNAEFLTCNIPTSNASNNMVTTEKVENGQEPVIKLENRQEARPEPARLKPPVHYNGPSK 443

Query: 350  SSYENLLRTPTPPEVTKIPEDILQLLSKYNSNLATPIAIKAVPPSKRFLKHG 401
            + Y +        +   IP+D+      NS  A P  +A+       F HG
Sbjct: 444  AGYVDFENGQWATD--DIPDDL------NSIRAAPGEFRAIMEMPSFYSHG 486
```

Figure 20 A-F: Alignment of the six 193P1E1B variants with a protein of unknown function.

A) Alignment of 193P1E1Bv.1
Identities = 329/330 (99%), Positives = 329/330 (99%)

(SEQ ID NO: 1309)

```
193P1: 83
MEKNSMDIMKIREYFQKYGYSPRVKKNSVHEQEAINSDPELSNCENFQKTDVKDDLSDP
P 142

MEKNSMDIMKIREYFQKYGYSPRVKKNSVHEQEAINSDPELSNCENFQKTDVKDDLSDP
P
  Sbjct: 1
MEKNSMDIMKIREYFQKYGYSPRVKKNSVHEQEAINSDPELSNCENFQKTDVKDDLSDP
P 60
```

(SEQ ID NO: 2989)

```
193P1: 143
VASSCISGKSPRSPQLSDFGLERYIVSQVLPNPPQAVNNYKEEPVIVTPPTKQSLVKVL
K 202
         VASSCIS
KSPRSPQLSDFGLERYIVSQVLPNPPQAVNNYKEEPVIVTPPTKQSLVKVLK
  Sbjct: 61
VASSCISEKSPRSPQLSDFGLERYIVSQVLPNPPQAVNNYKEEPVIVTPPTKQSLVKVL
K 120

193P1: 203
TPKCALKMDDFECVTPKLEHFGISEYTMCLNEDYTMGLKNARNNKSEEAIDAESRLNDN
V 262

TPKCALKMDDFECVTPKLEHFGISEYTMCLNEDYTMGLKNARNNKSEEAIDAESRLNDN
V
  Sbjct: 121
TPKCALKMDDFECVTPKLEHFGISEYTMCLNEDYTMGLKNARNNKSEEAIDAESRLNDN
V 180

193P1: 263
FATPSPIIQQLEKSDAEYTNSPLVPTFCTPGLKIPSTKNSIALVSTNYPLSKTNSSSND
L 322

FATPSPIIQQLEKSDAEYTNSPLVPTFCTPGLKIPSTKNSIALVSTNYPLSKTNSSSND
L
  Sbjct: 181
FATPSPIIQQLEKSDAEYTNSPLVPTFCTPGLKIPSTKNSIALVSTNYPLSKTNSSSND
L 240
```

193P1: 323
EVEDRTSLVLNSDTCFENLTDPSSPTISSYENLLRTPTPPEVTKIPEDILQLLSKYNSN
L 382

EVEDRTSLVLNSDTCFENLTDPSSPTISSYENLLRTPTPPEVTKIPEDILQLLSKYNSN
L
Sbjct: 241
EVEDRTSLVLNSDTCFENLTDPSSPTISSYENLLRTPTPPEVTKIPEDILQLLSKYNSN
L 300

193P1: 383 ATPIAIKAVPPSKRFLKHGQNIRDVSNKEN 412
ATPIAIKAVPPSKRFLKHGQNIRDVSNKEN
Sbjct: 301 ATPIAIKAVPPSKRFLKHGQNIRDVSNKEN 330

B) Alignment of 193P1E1Bv.2
Identities = 330/330 (100%), Positives = 330/330 (100%)

(SEQ ID NO: 2985)

193P1: 83
MEKNSMDIMKIREYFQKYGYSPRVKKNSVHEQEAINSDPELSNCENFQKTDVKDDLSDP
P 142

MEKNSMDIMKIREYFQKYGYSPRVKKNSVHEQEAINSDPELSNCENFQKTDVKDDLSDP
P
Sbjct: 1
MEKNSMDIMKIREYFQKYGYSPRVKKNSVHEQEAINSDPELSNCENFQKTDVKDDLSDP
P 60

(SEQ ID NO: 2989)

193P1: 143
VASSCISEKSPRSPQLSDFGLERYIVSQVLPNPPQAVNNYKEEPVIVTPPTKQSLVKVL
K 202

VASSCISEKSPRSPQLSDFGLERYIVSQVLPNPPQAVNNYKEEPVIVTPPTKQSLVKVL
K
Sbjct: 61
VASSCISEKSPRSPQLSDFGLERYIVSQVLPNPPQAVNNYKEEPVIVTPPTKQSLVKVL
K 120

193P1: 203
TPKCALKMDDFECVTPKLEHFGISEYTMCLNEDYTMGLKNARNNKSEEAIDTESRLNDN
V 262

TPKCALKMDDFECVTPKLEHFGISEYTMCLNEDYTMGLKNARNNKSEEAIDTESRLNDN
V

```
Sbjct: 121
TPKCALKMDDFECVTPKLEHFGISEYTMCLNEDYTMGLKNARNNKSEEAIDTESRLNDN
V 180

193P1: 263
FATPSPIIQQLEKSDAEYTNSPLVPTFCTPGLKIPSTKNSIALVSTNYPLSKTNSSSND
L 322

FATPSPIIQQLEKSDAEYTNSPLVPTFCTPGLKIPSTKNSIALVSTNYPLSKTNSSSND
L
Sbjct: 181
FATPSPIIQQLEKSDAEYTNSPLVPTFCTPGLKIPSTKNSIALVSTNYPLSKTNSSSND
L 240

193P1: 323
EVEDRTSLVLNSDTCFENLTDPSSPTISSYENLLRTPTPPEVTKIPEDILQLLSKYNSN
L 382

EVEDRTSLVLNSDTCFENLTDPSSPTISSYENLLRTPTPPEVTKIPEDILQLLSKYNSN
L
Sbjct: 241
EVEDRTSLVLNSDTCFENLTDPSSPTISSYENLLRTPTPPEVTKIPEDILQLLSKYNSN
L 300

193P1: 383 ATPIAIKAVPPSKRFLKHGQNIRDVSNKEN 412
           ATPIAIKAVPPSKRFLKHGQNIRDVSNKEN
Sbjct: 301 ATPIAIKAVPPSKRFLKHGQNIRDVSNKEN 330
```

C) Alignment of 193P1E1Bv.3
Identities = 330/330 (100%), Positives = 330/330 (100%)

(SEQ ID NO: 1310)
```
Query: 1
MEKNSMDIMKIREYFQKYGYSPRVKKNSVHEQEAINSDPELSNCENFQKTDVKDDLSDP
P 60

MEKNSMDIMKIREYFQKYGYSPRVKKNSVHEQEAINSDPELSNCENFQKTDVKDDLSDP
P
Sbjct: 1
MEKNSMDIMKIREYFQKYGYSPRVKKNSVHEQEAINSDPELSNCENFQKTDVKDDLSDP
P 60
```

(SEQ ID NO: 2989)
```
Query: 61
VASSCISEKSPRSPQLSDFGLERYIVSQVLPNPPQAVNNYKEEPVIVTPPTKQSLVKVL
K 120
```

```
VASSCISEKSPRSPQLSDFGLERYIVSQVLPNPPQAVNNYKEEPVIVTPPTKQSLVKVL
K
Sbjct: 61
VASSCISEKSPRSPQLSDFGLERYIVSQVLPNPPQAVNNYKEEPVIVTPPTKQSLVKVL
K 120

Query: 121
TPKCALKMDDFECVTPKLEHFGISEYTMCLNEDYTMGLKNARNNKSEEAIDAESRLNDN
V 180

TPKCALKMDDFECVTPKLEHFGISEYTMCLNEDYTMGLKNARNNKSEEAIDAESRLNDN
V
Sbjct: 121
TPKCALKMDDFECVTPKLEHFGISEYTMCLNEDYTMGLKNARNNKSEEAIDAESRLNDN
V 180

Query: 181
FATPSPIIQQLEKSDAEYTNSPLVPTFCTPGLKIPSTKNSIALVSTNYPLSKTNSSSND
L 240

FATPSPIIQQLEKSDAEYTNSPLVPTFCTPGLKIPSTKNSIALVSTNYPLSKTNSSSND
L
Sbjct: 181
FATPSPIIQQLEKSDAEYTNSPLVPTFCTPGLKIPSTKNSIALVSTNYPLSKTNSSSND
L 240

Query: 241
EVEDRTSLVLNSDTCFENLTDPSSPTISSYENLLRTPTPPEVTKIPEDILQLLSKYNSN
L 300

EVEDRTSLVLNSDTCFENLTDPSSPTISSYENLLRTPTPPEVTKIPEDILQLLSKYNSN
L
Sbjct: 241
EVEDRTSLVLNSDTCFENLTDPSSPTISSYENLLRTPTPPEVTKIPEDILQLLSKYNSN
L 300

Query: 301 ATPIAIKAVPPSKRFLKHGQNIRDVSNKEN 330
             ATPIAIKAVPPSKRFLKHGQNIRDVSNKEN
Sbjct: 301 ATPIAIKAVPPSKRFLKHGQNIRDVSNKEN 330
```

D) Alignment of 193P1E1B v. 4
Identities = 291/291 (100%), Positives = 291/291 (100%)

(SEQ ID NO: 1313)

Query: 83
MEKNSMDIMKIREYFQKYGYSPRVKKNSVHEQEAINSDPELSNCENFQKTDVKDDLSDP
P 142

MEKNSMDIMKIREYFQKYGYSPRVKKNSVHEQEAINSDPELSNCENFQKTDVKDDLSDP
P
Sbjct: 1
MEKNSMDIMKIREYFQKYGYSPRVKKNSVHEQEAINSDPELSNCENFQKTDVKDDLSDP
P 60

(SEQ ID NO: 2989)

Query: 143
VASSCISEKSPRSPQLSDFGLERYIVSQVLPNPPQAVNNYKEEPVIVTPPTKQSLVKVL
K 202

VASSCISEKSPRSPQLSDFGLERYIVSQVLPNPPQAVNNYKEEPVIVTPPTKQSLVKVL
K
Sbjct: 61
VASSCISEKSPRSPQLSDFGLERYIVSQVLPNPPQAVNNYKEEPVIVTPPTKQSLVKVL
K 120

Query: 203
TPKCALKMDDFECVTPKLEHFGISEYTMCLNEDYTMGLKNARNNKSEEAIDTESRLNDN
V 262

TPKCALKMDDFECVTPKLEHFGISEYTMCLNEDYTMGLKNARNNKSEEAIDTESRLNDN
V
Sbjct: 121
TPKCALKMDDFECVTPKLEHFGISEYTMCLNEDYTMGLKNARNNKSEEAIDTESRLNDN
V 180

Query: 263
FATPSPIIQQLEKSDAEYTNSPLVPTFCTPGLKIPSTKNSIALVSTNYPLSKTNSSSND
L 322

FATPSPIIQQLEKSDAEYTNSPLVPTFCTPGLKIPSTKNSIALVSTNYPLSKTNSSSND
L
Sbjct: 181
FATPSPIIQQLEKSDAEYTNSPLVPTFCTPGLKIPSTKNSIALVSTNYPLSKTNSSSND
L 240

Query: 323
EVEDRTSLVLNSDTCFENLTDPSSPTISSYENLLRTPTPPEVTKIPEDILQ 373

EVEDRTSLVLNSDTCFENLTDPSSPTISSYENLLRTPTPPEVTKIPEDILQ

Sbjct: 241
EVEDRTSLVLNSDTCFENLTDPSSPTISSYENLLRTPTPPEVTKIPEDILQ 291

E) Alignment of 193P1E1B v.5
Identities = 291/291 (100%), Positives = 291/291 (100%)

(SEQ ID NO: 1315)

Query: 1
MEKNSMDIMKIREYFQKYGYSPRVKKNSVHEQEAINSDPELSNCENFQKTDVKDDLSDP
P 60

MEKNSMDIMKIREYFQKYGYSPRVKKNSVHEQEAINSDPELSNCENFQKTDVKDDLSDP
P
Sbjct: 1
MEKNSMDIMKIREYFQKYGYSPRVKKNSVHEQEAINSDPELSNCENFQKTDVKDDLSDP
P 60

(portion of SEQ ID NO: 2989)

Query: 61
VASSCISEKSPRSPQLSDFGLERYIVSQVLPNPPQAVNNYKEEPVIVTPPTKQSLVKVL
K 120

VASSCISEKSPRSPQLSDFGLERYIVSQVLPNPPQAVNNYKEEPVIVTPPTKQSLVKVL
K
Sbjct: 61
VASSCISEKSPRSPQLSDFGLERYIVSQVLPNPPQAVNNYKEEPVIVTPPTKQSLVKVL
K 120

Query: 121
TPKCALKMDDFECVTPKLEHFGISEYTMCLNEDYTMGLKNARNNKSEEAIDTESRLNDN
V 180

TPKCALKMDDFECVTPKLEHFGISEYTMCLNEDYTMGLKNARNNKSEEAIDTESRLNDN
V
Sbjct: 121
TPKCALKMDDFECVTPKLEHFGISEYTMCLNEDYTMGLKNARNNKSEEAIDTESRLNDN
V 180

Query: 181
FATPSPIIQQLEKSDAEYTNSPLVPTFCTPGLKIPSTKNSIALVSTNYPLSKTNSSSND
L 240

FATPSPIIQQLEKSDAEYTNSPLVPTFCTPGLKIPSTKNSIALVSTNYPLSKTNSSSND
L

```
Sbjct: 181
FATPSPIIQQLEKSDAEYTNSPLVPTFCTPGLKIPSTKNSIALVSTNYPLSKTNSSSND
L 240

Query: 241
EVEDRTSLVLNSDTCFENLTDPSSPTISSYENLLRTPTPPEVTKIPEDILQ 291

EVEDRTSLVLNSDTCFENLTDPSSPTISSYENLLRTPTPPEVTKIPEDILQ
Sbjct: 241
EVEDRTSLVLNSDTCFENLTDPSSPTISSYENLLRTPTPPEVTKIPEDILQ 291
```

F) Alignment of 193P1E1B v. 6
Identities = 39/39 (100%), Positives = 39/39 (100%)

(portion of SEQ ID NO: 1317)

```
Query: 40   LLSKYNSNLATPIAIKAVPPSKRFLKHGQNIRDVSNKEN 78
            LLSKYNSNLATPIAIKAVPPSKRFLKHGQNIRDVSNKEN
Sbjct: 292  LLSKYNSNLATPIAIKAVPPSKRFLKHGQNIRDVSNKEN 330
```

(portion of SEQ ID NO: 2989)

NUCLEIC ACID AND CORRESPONDING PROTEIN ENTITLED 193P1E1B USEFUL IN TREATMENT AND DETECTION OF CANCER

FIELD OF THE INVENTION

The invention described herein relates to a gene and its encoded protein, termed 193P1E1B, expressed in certain cancers, and to diagnostic and therapeutic methods and compositions useful in the management of cancers that express 193P1E1B.

SUBMISSION ON COMPACT DISC

The contents of the following submission on compact discs are incorporated herein by reference in its entirety: A compact disc copy of the Sequence Listing (COPY 1) (file name: 511582006300, date recorded: Mar, 28, 2002, size: 598 KB); a duplicate compact disc copy of Sequence Listing (COPY 2) (file name: 511582006300, date recorded: Mar. 28, 2002, size: 598 KB); a computer readable form copy of the Sequence Listing (CRF COPY) (file name: 511582006300, date recorded: 28 Mar. 2002, size: 598 KB).

BACKGROUND OF THE INVENTION

Cancer is the second leading cause of human death next to coronary disease. Worldwide, millions of people die from cancer every year. In the United States alone, as reported by the American Cancer Society, cancer causes the death of well over a half-million people annually, with over 1.2 million new cases diagnosed per year. While deaths from heart disease have been declining significantly, those resulting from cancer generally are on the rise. In the early part of the next century, cancer is predicted to become the leading cause of death.

Worldwide, several cancers stand out as the leading killers. In particular, carcinomas of the lung, prostate, breast, colon, pancreas, and ovary represent the primary causes of cancer death. These and virtually all other carcinomas share a common lethal feature. With very few exceptions, metastatic disease from a carcinoma is fatal. Moreover, even for those cancer patients who initially survive their primary cancers, common experience has shown that their lives are dramatically altered. Many cancer patients experience strong anxieties driven by the awareness of the potential for recurrence or treatment failure. Many cancer patients experience physical debilitations following treatment. Furthermore, many cancer patients experience a recurrence.

Worldwide, prostate cancer is the fourth most prevalent cancer in men. In North America and Northern Europe, it is by far the most common cancer in males and is the second leading cause of cancer death in men. In the United States alone, well over 30,000 men die annually of this disease—second only to lung cancer. Despite the magnitude of these figures, there is still no effective treatment for metastatic prostate cancer. Surgical prostatectomy, radiation therapy, hormone ablation therapy, surgical castration and chemotherapy continue to be the main treatment modalities. Unfortunately, these treatments are ineffective for many and are often associated with undesirable consequences.

On the diagnostic front, the lack of a prostate tumor marker that can accurately detect early-stage, localized tumors remains a significant limitation in the diagnosis and management of this disease. Although the serum prostate specific antigen (PSA) assay has been a very useful tool, however its specificity and general utility is widely regarded as lacking in several important respects.

Progress in identifying additional specific markers for prostate cancer has been improved by the generation of prostate cancer xenografts that can recapitulate different stages of the disease in mice. The LAPC (Los Angeles Prostate Cancer) xenografts are prostate cancer xenografts that have survived passage in severe combined immune deficient (SCID) mice and have exhibited the capacity to mimic the transition from androgen dependence to androgen independence (Klein et al., 1997, Nat. Med. 3:402). More recently identified prostate cancer markers include PCTA-1 (Su et al., 1996, Proc. Natl. Acad. Sci. USA 93: 7252), prostate-specific membrane (PSM) antigen (Pinto et al., Clin Cancer Res 1996 Sep 2 (9): 1445-51), STEAP (Hubert, et al., Proc Natl Acad Sci U S A. 1999 Dec. 7; 96(25): 14523-8) and prostate stem cell antigen (PSCA) (Reiter et al., 1998, Proc. Natl. Acad. Sci. USA 95: 1735).

While previously identified markers such as PSA, PSM, PCTA and PSCA have facilitated efforts to diagnose and treat prostate cancer, there is need for the identification of additional markers and therapeutic targets for prostate and related cancers in order to further improve diagnosis and therapy.

Renal cell carcinoma (RCC) accounts for approximately 3 percent of adult malignancies. Once adenomas reach a diameter of 2 to 3 cm, malignant potential exists. In the adult, two principal malignant renal tumors are renal cell adenocarcinoma and transitional cell carcinoma of the renal pelvis or ureter. The incidence of renal cell adenocarcinoma is estimated at more than 29,000 cases in the United States, and more than 11,600 patients died of this disease in 1998. Transitional cell carcinoma is less frequent, with an incidence of approximately 500 cases per year in the United States.

Surgery has been the primary therapy for renal cell adenocarcinoma for many decades. Until recently, metastatic disease has been refractory to any systemic therapy. With recent developments in systemic therapies, particularly immunotherapies, metastatic renal cell carcinoma may be approached aggressively in appropriate patients with a possibility of durable responses. Nevertheless, there is a remaining need for effective therapies for these patients.

Of all new cases of cancer in the United States, bladder cancer represents approximately 5 percent in men (fifth most common neoplasm) and 3 percent in women (eighth most common neoplasm). The incidence is increasing slowly, concurrent with an increasing older population. In 1998, there was an estimated 54,500 cases, including 39,500 in men and 15,000 in women. The age-adjusted incidence in the United States is 32 per 100,000 for men and 8 per 100,000 in women. The historic male/female ratio of 3:1 may be decreasing related to smoking patterns in women. There were an estimated 11,000 deaths from bladder cancer in 1998 (7,800 in men and 3,900 in women). Bladder cancer incidence and mortality strongly increase with age and will be an increasing problem as the population becomes more elderly.

Most bladder cancers recur in the bladder. Bladder cancer is managed with a combination of transurethral resection of the bladder (TUR) and intravesical chemotherapy or immunotherapy. The multifocal and recurrent nature of bladder cancer points out the limitations of TUR. Most muscle-invasive cancers are not cured by TUR alone. Radical cystectomy and urinary diversion is the most effective means to eliminate the cancer but carry an undeniable impact on urinary and sexual function. There continues to be a significant need for treatment modalities that are beneficial for bladder cancer patients.

An estimated 130,200 cases of colorectal cancer occurred in 2000 in the United States, including 93,800 cases of colon cancer and 36,400 of rectal cancer. Colorectal cancers are the third most common cancers in men and women. Incidence rates declined significantly during 1992-1996 (−2.1% per year). Research suggests that these declines have been due to increased screening and polyp removal, preventing progression of polyps to invasive cancers. There were an estimated 56,300 deaths (47,700 from colon cancer, 8,600 from rectal cancer) in 2000, accounting for about 11% of all U.S. cancer deaths.

At present, surgery is the most common form of therapy for colorectal cancer, and for cancers that have not spread, it is frequently curative. Chemotherapy, or chemotherapy plus radiation, is given before or after surgery to most patients whose cancer has deeply perforated the bowel wall or has spread to the lymph nodes. A permanent colostomy (creation of an abdominal opening for elimination of body wastes) is occasionally needed for colon cancer and is infrequently required for rectal cancer. There continues to be a need for effective diagnostic and treatment modalities for colorectal cancer.

There were an estimated 164,100 new cases of lung and bronchial cancer in 2000, accounting for 14% of all U.S. cancer diagnoses. The incidence rate of lung and bronchial cancer is declining significantly in men, from a high of 86.5 per 100,000 in 1984 to 70.0 in 1996. In the 1990s, the rate of increase among women began to slow. In 1996, the incidence rate in women was 42.3 per 100,000.

Lung and bronchial cancer caused an estimated 156,900 deaths in 2000, accounting for 28% of all cancer deaths. During 1992-1996, mortality from lung cancer declined significantly among men (−1.7% per year) while rates for women were still significantly increasing (0.9% per year). Since 1987, more women have died each year of lung cancer than breast cancer, which, for over 40 years, was the major cause of cancer death in women. Decreasing lung cancer incidence and mortality rates most likely resulted from decreased smoking rates over the previous 30 years; however, decreasing smoking patterns among women lag behind those of men. Of concern, although the declines in adult tobacco use have slowed, tobacco use in youth is increasing again.

Treatment options for lung and bronchial cancer are determined by the type and stage of the cancer and include surgery, radiation therapy, and chemotherapy. For many localized cancers, surgery is usually the treatment of choice. Because the disease has usually spread by the time it is discovered, radiation therapy and chemotherapy are often needed in combination with surgery. Chemotherapy alone or combined with radiation is the treatment of choice for small cell lung cancer; on this regimen, a large percentage of patients experience remission, which in some cases is long lasting. There is however, an ongoing need for effective treatment and diagnostic approaches for lung and bronchial cancers.

An estimated 182,800 new invasive cases of breast cancer were expected to occur among women in the United States during 2000. Additionally, about 1,400 new cases of breast cancer were expected to be diagnosed in men in 2000. After increasing about 4% per year in the 1980s, breast cancer incidence rates in women have leveled off in the 1990s to about 110.6 cases per 100,000.

In the U.S. alone, there were an estimated 41,200 deaths (40,800 women, 400 men) in 2000 due to breast cancer. Breast cancer ranks second among cancer deaths in women. According to the most recent data, mortality rates declined significantly during 1992-1996 with the largest decreases in younger women, both white and black. These decreases were probably the result of earlier detection and improved treatment.

Taking into account the medical circumstances and the patient's preferences, treatment of breast cancer may involve lumpectomy (local removal of the tumor) and removal of the lymph nodes under the arm; mastectomy (surgical removal of the breast) and removal of the lymph nodes under the arm; radiation therapy; chemotherapy; or hormone therapy. Often, two or more methods are used in combination. Numerous studies have shown that, for early stage disease, long-term survival rates after lumpectomy plus radiotherapy are similar to survival rates after modified radical mastectomy. Significant advances in reconstruction techniques provide several options for breast reconstruction after mastectomy. Recently, such reconstruction has been done at the same time as the mastectomy.

Local excision of ductal carcinoma in situ (DCIS) with adequate amounts of surrounding normal breast tissue may prevent the local recurrence of the DCIS. Radiation to the breast and/or tamoxifen may reduce the chance of DCIS occurring in the remaining breast tissue. This is important because DCIS, if left untreated, may develop into invasive breast cancer. Nevertheless, there are serious side effects or sequelae to these treatments. There is, therefore, a need for efficacious breast cancer treatments.

There were an estimated 23,100 new cases of ovarian cancer in the United States in 2000. It accounts for 4% of all cancers among women and ranks second among gynecologic cancers. During 1992-1996, ovarian cancer incidence rates were significantly declining. Consequent to ovarian cancer, there were an estimated 14,000 deaths in 2000. Ovarian cancer causes more deaths than any other cancer of the female reproductive system.

Surgery, radiation therapy, and chemotherapy are treatment options for ovarian cancer. Surgery usually includes the removal of one or both ovaries, the fallopian tubes (salpingo-oophorectomy), and the uterus (hysterectomy). In some very early tumors, only the involved ovary will be removed, especially in young women who wish to have children. In advanced disease, an attempt is made to remove all intra-abdominal disease to enhance the effect of chemotherapy. There continues to be an important need for effective treatment options for ovarian cancer.

There were an estimated 28,300 new cases of pancreatic cancer in the United States in 2000. Over the past 20 years, rates of pancreatic cancer have declined in men. Rates among women have remained approximately constant but may be beginning to decline. Pancreatic cancer caused an estimated 28,200 deaths in 2000 in the United States. Over the past 20 years, there has been a slight but significant decrease in mortality rates among men (about −0.9% per year) while rates have increased slightly among women.

Surgery, radiation therapy, and chemotherapy are treatment options for pancreatic cancer. These treatment options can extend survival and/or relieve symptoms in many patients but are not likely to produce a cure for most. There is a significant need for additional therapeutic and diagnostic options for pancreatic cancer.

SUMMARY OF THE INVENTION

The present invention relates to a gene, designated 193P1E1B, that has now been found to be over-expressed in the cancer(s) listed in Table I. Northern blot expression analysis of 193P1E1B gene expression in normal tissues shows a restricted expression pattern in adult tissues. The nucleotide (FIG. 2) and amino acid (FIG. 2, and FIG. 3) sequences of 193P1E1B are provided. The tissue-related profile of 193P1E1B in normal adult tissues, combined with the overexpression observed in the tumors listed in Table I, shows that 193P1E1B is aberrantly over-expressed in at least some cancers, and thus serves as a useful diagnostic, prophylactic, prognostic, and/or therapeutic target for cancers of the tissue(s) such as those listed in Table I.

The invention provides polynucleotides corresponding or complementary to all or part of the 193P1E1B genes, mRNAs, and/or coding sequences, preferably in isolated form, including polynucleotides encoding 193P1E1B-related proteins and fragments of 4, 5, 6, 7, 8, 9, 10, 11, 12, 13, 14, 15, 16, 17, 18, 19, 20, 21, 22, 23, 24, 25, or more than 25 contiguous amino acids; at least 30, 35, 40, 45, 50, 55, 60, 65, 70, 80, 85, 90, 95, 100 or more than 100 contiguous amino acids of a 193P1E1B-related protein, as well as the peptides/proteins themselves; DNA, RNA, DNA/RNA hybrids, and related molecules, polynucleotides or oligonucleotides complementary or having at least a 90% homology to the 193P1E1B genes or mRNA sequences or parts thereof, and polynucleotides or oligonucleotides that hybridize to the 193P1E1B genes, mRNAs, or to 193P1E1B-encoding polynucleotides. Also provided are means for isolating cDNAs and the genes encoding 193P1E1B. Recombinant DNA molecules containing 193P1E1B polynucleotides, cells transformed or transduced with such molecules, and host-vector systems for the expression of 193P1E1B gene products are also provided. The invention further provides antibodies that bind to 193P1E1B proteins and polypeptide fragments thereof, including polyclonal and monoclonal antibodies, murine and other mammalian antibodies, chimeric antibodies, humanized and fully human antibodies, and antibodies labeled with a detectable marker or therapeutic agent. In certain embodiments there is a proviso that the entire nucleic acid sequence of FIG. 2 is not encoded and/or the entire amino acid sequence of FIG. 2 is not prepared. In certain embodiments, the entire nucleic acid sequence of FIG. 2 is encoded and/or the entire amino acid sequence of FIG. 2 is prepared, either of which are in respective human unit dose forms.

The invention further provides methods for detecting the presence and status of 193P1E1B polynucleotides and proteins in various biological samples, as well as methods for identifying cells that express 193P1E1B. A typical embodiment of this invention provides methods for monitoring 193P1E1B gene products in a tissue or hematology sample having or suspected of having some form of growth dysregulation such as cancer.

The invention further provides various immunogenic or therapeutic compositions and strategies for treating cancers that express 193P1E1B such as cancers of tissues listed in Table I, including therapies aimed at inhibiting the transcription, translation, processing or function of 193P1E1B as well as cancer vaccines. In one aspect, the invention provides compositions, and methods comprising them, for treating a cancer that expresses 193P1E1B in a human subject wherein the composition comprises a carrier suitable for human use and a human unit dose of one or more than one agent that inhibits the production or function of 193P1E1B. Preferably, the carrier is a uniquely human carrier. In another aspect of the invention, the agent is a moiety that is immunoreactive with 193P1E1B protein. Non-limiting examples of such moieties include, but are not limited to, antibodies (such as single chain, monoclonal, polyclonal, humanized, chimeric, or human antibodies), functional equivalents thereof (whether naturally occurring or synthetic), and combinations thereof. The antibodies can be conjugated to a diagnostic or therapeutic moiety. In another aspect, the agent is a small molecule as defined herein.

In another aspect, the agent comprises one or more than one peptide which comprises a cytotoxic T lymphocyte (CTL) epitope that binds an HLA class I molecule in a human to elicit a CTL response to 193P1E1B and/or one or more than one peptide which comprises a helper T lymphocyte (HTL) epitope which binds an HLA class II molecule in a human to elicit an HTL response. The peptides of the invention may be on the same or on one or more separate polypeptide molecules. In a further aspect of the invention, the agent comprises one or more than one nucleic acid molecule that expresses one or more than one of the CTL or HTL response stimulating peptides as described above. In yet another aspect of the invention, the one or more than one nucleic acid molecule may express a moiety that is immunologically reactive with 193P1E1B as described above. The one or more than one nucleic acid molecule may also be, or encodes, a molecule that inhibits production of 193P1E1B. Non-limiting examples of such molecules include, but are not limited to, those complementary to a nucleotide sequence essential for production of 193P1E1B (e.g. antisense sequences or molecules that form a triple helix with a nucleotide double helix essential for 193P1E1B production) or a ribozyme effective to lyse 193P1E1B mRNA.

BRIEF DESCRIPTION OF THE FIGURES

FIG. 1. The 193P1E1B SSH (SEQ ID NO: 2982) sequence of 227 nucleotides.

FIG. 2. The cDNA (SEQ ID. NO.: 1308) and amino acid sequence (SEQ ID. NO.: 2983) of 193P1E1B v.1 is shown in FIG. 2A. The start methionine is underlined. The open reading frame extends from nucleic acid 805-2043 including the stop codon. The nucleic acid and amino acid sequence of 193P1E1B variant 2 (SEQ ID. NOS. 2984 & 2985) is shown in FIG. 2B, the codon for the start methionine is underlined. The open reading frame for variant 2 extends from nucleic acid 805 to 2043 including the stop codon. The nucleic acid and amino acid sequence of 193P1E1B variant 3 (SEQ ID. NOS. 2986 & 1310) is shown in FIG. 2C, the codon for the start methionine is underlined. The open reading frame for variant 3 extends from nucleic acid 185-1177 including the stop codon. The nucleic acid and amino acid sequence of 193P1E1B variant 4 (SEQ ID. NOS. 1311 & 1313) is shown in FIG. 2D, the codon for the start methionine is underlined. The open reading frame for variant 4 extends from nucleic acid 805-1971 including the stop codon. The nucleic acid and amino acid sequence of 193P1E1B variant 5 (SEQ ID. NOS. 1314 & 1315) is shown in FIG. 2E, the codon for the start methionine is underlined. The open reading frame for variant 5 extends from nucleic acid 989-1909 including the stop codon. The nucleic acid and amino acid sequence of 193P1E1B variant 6 (SEQ ID. NOS. 1316 & 1317) is shown in FIG. 2F, the codon for the start methionine is underlined. The open reading frame for variant 6 extends from nucleic acid 805-1026 including the stop codon.

FIG. 3. Amino acid sequence of 193P1E1B variant 1 (SEQ ID. NO.: 2983) is shown in FIG. 3A and the amino acid sequence of 193P1E1B variant 2 (SEQ ID. NO.: 2985) is shown in FIG. 3B. Variant 1 and variant 2 proteins each have 412 amino acids. The amino acid sequence of 193P1E1B variant 3 (SEQ ID. NO.: 1310) is shown in FIG. 3C, the 193P1E1B v.3 protein has 330 amino acids. The amino acid sequence of 193P1E1B variant 4 (SEQ ID. NO.: 1313) is shown in FIG. 3D, the 193P1E1B v.4 protein has 388 amino acids. The amino acid sequence of 193P1E1B variant 5 (SEQ ID. NO.: 1315) is shown in FIG. 3E, the 193P1E1B v.5 protein has 306 amino acids. The amino acid sequence of 193P1E1B variant 6 (SEQ ID. NO.: 1317) is shown in FIG. 3F, the 193P1E1B v.6 protein has 73 amino acids.

FIG. 4. The amino acid alignments of 193P1E1B variants 1-6 (SEQ ID NOS 2983,2985, 1310, 1313, 1315, 1317, respectively, in order of appearance).

FIG. 5. Hydrophilicity amino acid profile of 193P1E1B determined by computer algorithm sequence analysis using the method of Hoop and Woods (Hoop T. P., Woods K. R., 1981. Proc. Natl. Acad. Sci. U.S.A. 78:3824-3828) accessed on the Protscale website through the ExPasy molecular bilogy server.

FIG. 6. Hydropathicity amino acid profile of 193P1E1B determined by computer algorithm sequence analysis using the method of Kyte and Doolittle (Kyte J., Doolittle R. F., 1982. J. Mol. Biol. 157:105-132) accessed on the Protscale website through the ExPasy molecular server.

FIG. 7. Percent accessible residues amino acid profile 193P1E1B determined by computer algoritm sequence analysis using the method of Janin (Janin J., 1979 Nature 277:491-492) accessed on the Protscale website through the ExPasy molecular bilogy server.

FIG. 8. Average flexibility amino acid profile 193P1E1B determined by computer algorithm sequence analysis using the method of Bhaskaran and Ponnuswamy (Bhaskaran R., and Ponnuswamy P. K., 1988.Int. Pept. Protein Res. 32:242-255) accessed on the Protscale website Through the ExPasy molecular server.

FIG. 9. Beta-turn amino acid profile of 193P1E1B determined by computer algorithm sequence analysis using the method of Deleage and Roux (Deleage, G., Roux B. 1987 Protein Engineering 1:289-294) accessed on the Protscale webite through the ExPasy molecular bilogy server.

FIG. 10. Expression of 193P1E1B by RT-PCR. FIG. 10 Panel A depicts a schematic diagram of the location of the PCR primers set A and set B on the sequences of the variants 1-3 of 193P1E1B. For the data in Panels B and C first strand cDNA was prepared from vital pool 1 (VP1: liver, lung and kidney), vital pool 2 (VP2, pancreas, colon and stomach), prostate xenograft pool (LAPC-4AD, LAPC-4AI, LAPC-9AD, LAPC-9AI), normal thymus, prostate cancer pool, bladder cancer pool, kidney cancer pool, colon cancer pool, lung cancer pool, ovary cancer pool, breast cancer pool, metastasis cancer pool, pancreas cancer pool, and from prostate cancer metastasis to lymph node from two different patients. Normalization was performed by PCR using primers to actin and GAPDH. Semi-quantitative PCR, using primer Set A (FIG. 10 Panel B) or primer Set B (FIG. 10 Panel C) to 193P1E1B, was performed at 26 and/or 30 cycles of amplification. Strong expression of 193P1E1B was observed in prostate cancer xenograft pool, bladder cancer pool, kidney cancer pool, colon cancer pool, lung cancer pool, ovary cancer pool, breast cancer pool, metastasis pool, pancreas cancer pool, and in the two different prostate cancer metastasis to lymph node. Low expression was observed in prostate cancer pool, and no expression was detected in VP1 and VP2. 193P1E1B v.1, 193P1E1B v.2 and 193P1E1B v.3 are expressed in all tissues tested.

FIG. 11. Expression of 193P1E1B in normal human tissues. Two multiple tissue Northern blots, with 2 μg of mRNA/lane, were probed with 193P1E1B SSH sequence. Size standards in kilobases (kb) are indicated on the side. The results show expression of two 193P1E1B transcripts, approximately 3.5 kb and 2 kb, in testis and thymus.

FIG. 12. Expression of 193P1E1B in prostate cancer xenografts. RNA was extracted from normal prostate, and from prostate cancer xenografts, LAPC-4AD, LAPC-4AI, LAPC-9AD, and LAPC-9AI. Northern blots with 10 μg of total RNA/lane were probed with 193P1E1B SSH sequence. Size standards in kilobases (kb) are indicated on the side. The results show expression of 193P1E1B in all 4 xenografts but not in normal prostate.

FIG. 13. Expression of 193P1E1B in patient cancer specimens. RNA was extracted from a pool of three patients for each of the following, bladder cancer, colon cancer, ovary cancer and metastatic cancer, as well as from normal prostate (NP), normal bladder (NB), normal kidney (NK), normal colon (NC). Northern blots with 10 μg of total RNA/lane were probed with 193P1E1B SSH sequence. Size standards in kilobases (kb) are indicated on the side. The results show expression of 193P1E1B in bladder cancer pool, colon cancer pool, ovary cancer pool and metastasis cancer pool, but not in any of the normal tissues tested.

FIG. 14. Expression of 193P1E1B in bladder cancer patient specimens. RNA was extracted from bladder cancer cell lines (CL), normal bladder (N), bladder tumors (T) and matched normal adjacent tissue (NAT) isolated from bladder cancer patients. Northern blots with 10 μg of total RNA/lane were probed with 193P1E1B SSH sequence. Size standards in kilobases (kb) are indicated on the side. The results show expression of 193P1E1B in the two bladder cancer cell lines, and in 3 patient bladder tumors tested but not in normal bladder tissues.

FIG. 15. Expression of 193P1E1B in cancer metastasis patient specimens. RNA was extracted from the following cancer metastasis tissues, colon metastasis to lung, lung metastasis to lymph node, lung metastasis to skin, and breast metastasis to lymph node, as well as from normal bladder (NB), normal lung (NL), normal breast (NBr), and normal ovary (NO). Northern blots with 10 μg of total RNA/lane were probed with 193P1E1B SSH sequence. Size standards in kilobases (kb) are indicated on the side. The results show expression of 193P1E1B in all four different cancer metastasis samples but not in normal tissues.

FIG. 16. Expression of 193P1E1B in pancreas, ovary and testis cancer patient specimens. RNA was extracted from pancreatic cancer (P1), ovarian cancer (P2, P3), and testicular cancer (P4, P5) isolated from cancer patients, as well as from normal pancreas (NPa). Northern blots with 10 μg of total RNA/lane were probed with 193P1E1B SSH sequence. Size standards in kilobases (kb) are indicated on the side. The results show expression of 193P1E1B in pancreatic, ovarian and testicular cancer specimens but not in normal pancreas.

FIG. 17: Secondary structure prediction for 193P1E1B. The secondary structure of 193P1E1B protein was predicted using the HNN—Heirarchial Neural Network method (Guermeur, 1997), accessed from the ExPasy molecular biology server. This method predicts the presence and location of alpha helices, extended strands, random coils from the primary protein sequence. The percent of the protein in a given secondary structure is as follows: h: Alpha helis 29.13%; c: Random coil 60.92%; e: Extended strand 9.95%.

FIG. 18: Alignment of 193P1E1B variant 3 (SEQ ID NO: 2987) with DRADA (P55265) (SEQ ID NO: 2988).

FIG. 20: FIGS. 20A-F: Alignment of 193P1E1B variants with a protein of unknown function (SEQ ID NO: 2989):

Figure 19:
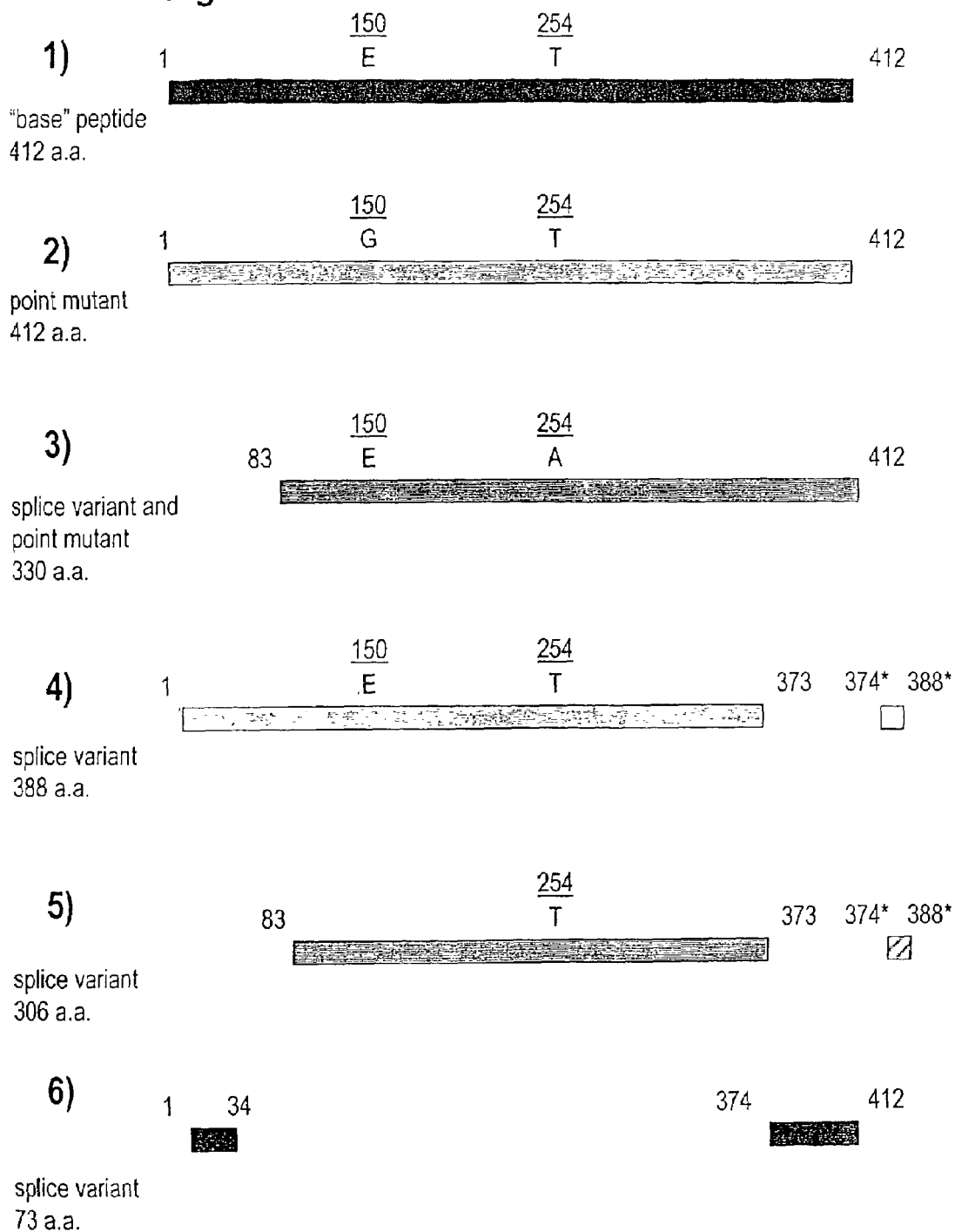
FIG. 19: A graphic alignment of 193P1E1B variants 1 to 6 (i.e., v.1 to v.6). Variants 1 and 2 have 412 amino acids; variant 3 has 330 amino acids; variant 4 has 388 amino acids; variant 5 has 306 amino acids and variant 6 has 73 amino acids. In this Figure all position numbers are relative to the numbering in Variant 1, with the exception of the segments shown with crosshatched lines in Variants 4 and 5. The segments shown with crosshatching are not present in Variant 1; the position numbers for these segments is relative to Variant 4.

Panel A) Alignment of 193P1E1Bv.1 (SEQ ID NO: 1309), Panel B) Alignment of 193P1E1Bv.2 (portion of SEQ ID NO: 2985), Panel C) Alignment of 193P1E1Bv.3 (SEQ ID NO: 1310). Panel D) Alignment of 193P1E1B v. 4 (SEQ ID NO: 1313), Panel E) Alignment of 193P1E1B v.5 (portion of SEQ ID NO: 1315), and Panel F) Alignment of 193P1E1B v.6 (portion of SEQ ID NO: 1317)

DETAILED DESCRIPTION OF THE INVENTION

Outline of Sections
I.) Definitions
II.) 193P1E1B Polynucleotides
II.A.) Uses of 193P1E1B Polynucleotides
   II.A.1.) Monitoring of Genetic Abnormalities
   II.A.2.) Antisense Embodiments
   II.A.3.) Primers and Primer Pairs
   II.A.4.) Isolation of 193P1E1B-Encoding Nucleic Acid Molecules
   II.A.5.) Recombinant Nucleic Acid Molecules and Host-Vector Systems
III.) 193P1E1B-related Proteins
III.A.) Motif-bearing Protein Embodiments
III.B.) Expression of 193P1E1B-related Proteins
III.C.) Modifications of 193P1E1B-related Proteins
III.D.) Uses of 193P1E1B-related Proteins
IV.) 193P1E1B Antibodies
V.) 193P1E1B Cellular Immune Responses
VI.) 193P1E1B Transgenic Animals
VII.) Methods for the Detection of 193P1E1B
VIII.) Methods for Monitoring the Status of 193P1E1B-related Genes and Their Products
IX.) Identification of Molecules That Interact With 193P1E1B
X.) Therapeutic Methods and Compositions
X.A.) Anti-Cancer Vaccines
X.B.) 193P1E1B as a Target for Antibody-Based Therapy
X.C.) 193P1E1B as a Target for Cellular Immune Responses
   X.C.1. Minigene Vaccines
   X.C.2. Combinations of CTL Peptides with Helper Peptides
   X.C.3. Combinations of CTL Peptides with T Cell Priming Agents
   X.C.4. Vaccine Compositions Comprising DC Pulsed with CTL and/or HTL Peptides
X.D.) Adoptive Immunotherapy
X.E.) Administration of Vaccines for Therapeutic or Prophylactic Purposes
XI.) Diagnostic and Prognostic Embodiments of 193P1E1B.
XII.) Inhibition of 193P1E1B Protein Function
XII.A.) Inhibition of 193P1E1B With Intracellular Antibodies
XII.B.) Inhibition of 193P1E1B with Recombinant Proteins
XII.C.) Inhibition of 193P1E1B Transcription or Translation
XII.D.) General Considerations for Therapeutic Strategies
XIII.) KITS
I.) Definitions:

Unless otherwise defined, all terms of art, notations and other scientific terms or terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a substantial difference over what is generally understood in the art. Many of the techniques and procedures described or referenced herein are well understood and commonly employed using conventional methodology by those skilled in the art, such as, for example, the widely utilized molecular cloning methodologies described in Sambrook et al., Molecular Cloning: A Laboratory Manual 2nd. edition (1989) Cold Spring Harbor Laboratory Press, Cold Spring Harbor, N.Y. As appropriate, procedures involving the use of commercially available kits and reagents are generally carried out in accordance with manufacturer defined protocols and/or parameters unless otherwise noted.

The terms "advanced prostate cancer", "locally advanced prostate cancer", "advanced disease" and "locally advanced disease" mean prostate cancers that have extended through the prostate capsule, and are meant to include stage C disease under the American Urological Association (AUA) system, stage C1-C2 disease under the Whitmore-Jewett system, and stage T3-T4 and N+ disease under the TNM (tumor, node, metastasis) system. In general, surgery is not recommended for patients with locally advanced disease, and these patients have substantially less favorable outcomes compared to patients having clinically localized (organ-confined) prostate cancer. Locally advanced disease is clinically identified by palpable evidence of induration beyond the lateral border of the prostate, or asymmetry or induration above the prostate base. Locally advanced prostate cancer is presently diagnosed pathologically following radical prostatectomy if the tumor invades or penetrates the prostatic capsule, extends into the surgical margin, or invades the seminal vesicles.

"Altering the native glycosylation pattern" is intended for purposes herein to mean deleting one or more carbohydrate moieties found in native sequence 193P1E1B (either by removing the underlying glycosylation site or by deleting the glycosylation by chemical and/or enzymatic means), and/or adding one or more glycosylation sites that are not present in the native sequence 193P1E1B. In addition, the phrase includes qualitative changes in the glycosylation of the native proteins, involving a change in the nature and proportions of the various carbohydrate moieties present.

The term "analog" refers to a molecule which is structurally similar or shares similar or corresponding attributes with another molecule (e.g. a 193P1E1B-related protein). For example an analog of a 193P1E1B protein can be specifically bound by an antibody or T cell that specifically binds to 193P1E1B.

The term "antibody" is used in the broadest sense. Therefore an "antibody" can be naturally occurring or man-made such as monoclonal antibodies produced by conventional hybridoma technology. Anti-193P1E1B antibodies comprise monoclonal and polyclonal antibodies as well as fragments containing the antigen-binding domain and/or one or more complementarity determining regions of these antibodies.

An "antibody fragment" is defined as at least a portion of the variable region of the immunoglobulin molecule that binds to its target, i.e., the antigen-binding region. In one embodiment it specifically covers single anti-193P1E1B antibodies and clones thereof (including agonist, antagonist and neutralizing antibodies) and anti-193P1E1B antibody compositions with polyepitopic specificity.

The term "codon optimized sequences" refers to nucleotide sequences that have been optimized for a particular host species by replacing any codons having a usage frequency of less than about 20%. Nucleotide sequences that have been optimized for expression in a given host species by elimination of spurious polyadenylation sequences, elimination of exon/intron splicing signals, elimination of transposon-like repeats and/or optimization of GC content in addition to codon optimization are referred to herein as an "expression enhanced sequences."

The term "cytotoxic agent" refers to a substance that inhibits or prevents the expression activity of cells, function of cells and/or causes destruction of cells. The term is intended to include radioactive isotopes chemotherapeutic agents, and toxins such as small molecule toxins or enzymatically active toxins of bacterial, fungal, plant or animal origin, including fragments and/or variants thereof. Examples of cytotoxic agents include, but are not limited to maytansinoids, yttrium, bismuth, ricin, ricin A-chain, doxorubicin, daunorubicin, taxol, ethidium bromide, mitomycin, etoposide, tenoposide, vincristine, vinblastine, colchicine, dihydroxy anthracin dione, actinomycin, diphtheria toxin, Pseudomonas exotoxin (PE) A, PE40, abrin, abrin A chain, modeccin A chain, alpha-sarcin, gelonin, mitogellin, retstrictocin, phenomycin, enomycin, curicin, crotin, calicheamicin, sapaonaria officinalis inhibitor, and glucocorticoid and other chemotherapeutic agents, as well as radioisotopes such as $At^{211}$, $I^{131}$, $I^{125}$, $Y^{90}$, $Re^{186}$, $Re^{188}$, $Sm^{153}$, $Bi^{212}$, $P^{32}$ and radioactive isotopes of Lu. Antibodies may also be conjugated to an anti-cancer pro-drug activating enzyme capable of converting the pro-drug to its active form.

The term "homolog" refers to a molecule which exhibits homology to another molecule, by for example, having sequences of chemical residues that are the same or similar at corresponding positions.

"Human Leukocyte Antigen" or "HLA" is a human class I or class II Major Histocompatibility Complex (MHC) protein (see, e.g., Stites, et al., IMMUNOLOGY, $8^{TH}$ ED., Lange Publishing, Los Altos, Calif. (1994).

The terms "hybridize", "hybridizing", "hybridizes" and the like, used in the context of polynucleotides, are meant to refer to conventional hybridization conditions, preferably such as hybridization in 50% formamide/6×SSC/0.1% SDS/100 µg/ml ssDNA, in which temperatures for hybridization are above 37 degrees C. and temperatures for washing in 0.1×SSC/0.1% SDS are above 55 degrees C.

The phrases "isolated" or "biologically pure" refer to material which is substantially or essentially free from components which normally accompany the material as it is found in its native state. Thus, isolated peptides in accordance with the invention preferably do not contain materials normally associated with the peptides in their in situ environment. For example, a polynucleotide is said to be "isolated" when it is substantially separated from contaminant polynucleotides that correspond or are complementary to genes other than the 193P1E1B genes or that encode polypeptides other than 193P1E1B gene product or fragments thereof. A skilled artisan can readily employ nucleic acid isolation procedures to obtain an isolated 193P1E1B polynucleotide. A protein is said to be "isolated," for example, when physical, mechanical or chemical methods are employed to remove the 193P1E1B proteins from cellular constituents that are normally associated with the protein. A skilled artisan can readily employ standard purification methods to obtain an isolated 193P1E1B protein. Alternatively, an isolated protein can be prepared by chemical means.

The term "mammal" refers to any organism classified as a mammal, including mice, rats, rabbits, dogs, cats, cows, horses and humans. In one embodiment of the invention, the mammal is a mouse. In another embodiment of the invention, the mammal is a human.

The terms "metastatic prostate cancer" and "metastatic disease" mean prostate cancers that have spread to regional lymph nodes or to distant sites, and are meant to include stage D disease under the AUA system and stage TxNxM+under the TNM system. As is the case with locally advanced prostate cancer, surgery is generally not indicated for patients with metastatic disease, and hormonal (androgen ablation) therapy is a preferred treatment modality. Patients with metastatic prostate cancer eventually develop an androgen-refractory state within 12 to 18 months of treatment initiation. Approximately half of these androgen-refractory patients die within 6 months after developing that status. The most common site for prostate cancer metastasis is bone. Prostate cancer bone metastases are often osteoblastic rather than osteolytic (i.e., resulting in net bone formation). Bone metastases are found most frequently in the spine, followed by the femur, pelvis, rib cage, skull and humerus. Other common sites for metastasis include lymph nodes, lung, liver and brain. Metastatic prostate cancer is typically diagnosed by open or laparoscopic pelvic lymphadenectomy, whole body radionuclide scans, skeletal radiography, and/or bone lesion biopsy.

The term "monoclonal antibody" refers to an antibody obtained from a population of substantially homogeneous antibodies, i.e., the antibodies comprising the population are identical except for possible naturally occurring mutations that are present in minor amounts.

A "motif", as in biological motif of an 193P1E1B-related protein, refers to any pattern of amino acids forming part of the primary sequence of a protein, that is associated with a particular function (e.g. protein-protein interaction, protein-DNA interaction, etc) or modification (e.g. that is phosphorylated, glycosylated or amidated), or localization (e.g. secretory sequence, nuclear localization sequence, etc.) or a sequence that is correlated with being immunogenic, either humorally or cellularly. A motif can be either contiguous or capable of being aligned to certain positions that are generally correlated with a certain function or property. In the context of HLA motifs, "motif" refers to the pattern of residues in a peptide of defined length, usually a peptide of from about 8 to about 13 amino acids for a class I HLA motif and from about 6 to about 25 amino acids for a class II HLA motif, which is recognized by a particular HLA molecule. Peptide motifs for HLA binding are typically different for each protein encoded by each human HLA allele and differ in the pattern of the primary and secondary anchor residues.

A "pharmaceutical excipient" comprises a material such as an adjuvant, a carrier, pH-adjusting and buffering agents, tonicity adjusting agents, wetting agents, preservative, and the like.

"Pharmaceutically acceptable" refers to a non-toxic, inert, and/or composition that is physiologically compatible with humans or other mammals.

The term "polynucleotide" means a polymeric form of nucleotides of at least 10 bases or base pairs in length, either ribonucleotides or deoxynucleotides or a modified form of either type of nucleotide, and is meant to include single and double stranded forms of DNA and/or RNA. In the art, this term if often used interchangeably with "oligonucleotide". A polynucleotide can comprise a nucleotide sequence disclosed herein wherein thymidine (T), as shown for example in FIG. 2, can also be uracil (U); this definition pertains to the differences between the chemical structures of DNA and RNA, in particular the observation that one of the four major bases in RNA is uracil (U) instead of thymidine (T).

The term "polypeptide" means a polymer of at least about 4, 5, 6, 7, or 8 amino acids. Throughout the specification, standard three letter or single letter designations for amino acids are used. In the art, this term is often used interchangeably with "peptide" or "protein".

An HLA "primary anchor residue" is an amino acid at a specific position along a peptide sequence which is understood to provide a contact point between the immunogenic peptide and the HLA molecule. One to three, usually two, primary anchor residues within a peptide of defined length generally defines a "motif" for an immunogenic peptide. These residues are understood to fit in close contact with peptide binding groove of an HLA molecule, with their side chains buried in specific pockets of the binding groove. In one embodiment, for example, the primary anchor residues for an HLA class I molecule are located at position 2 (from the amino terminal position) and at the carboxyl terminal position of a 8, 9, 10, 11, or 12 residue peptide epitope in accordance with the invention. In another embodiment, for example, the primary anchor residues of a peptide that will bind an HLA class II molecule are spaced relative to each other, rather than to the termini of a peptide, where the peptide is generally of at least 9 amino acids in length. The primary anchor positions for each motif and supermotif are set forth in Table IV. For example, analog peptides can be created by altering the presence or absence of particular residues in the primary and/or secondary anchor positions shown in Table IV. Such analogs are used to modulate the binding affinity and/or population coverage of a peptide comprising a particular HLA motif or supermotif.

A "recombinant" DNA or RNA molecule is a DNA or RNA molecule that has been subjected to molecular manipulation in vitro.

Non-limiting examples of small molecules include compounds that bind or interact with 193P1E1B, ligands including hormones, neuropeptides, chemokines, odorants, phospholipids, and functional equivalents thereof that bind and preferably inhibit 193P1E1B protein function. Such non-limiting small molecules preferably have a molecular weight of less than about 10 kDa, more preferably below about 9, about 8, about 7, about 6, about 5 or about 4 kDa. In certain embodiments, small molecules physically associate with, or bind, 193P1E1B protein; are not found in naturally occurring metabolic pathways; and/or are more soluble in aqueous than non-aqueous solutions "Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured nucleic acid sequences to reanneal when complementary strands are present in an environment below their melting temperature. The higher the degree of desired homology between the probe and hybridizable sequence, the higher the relative temperature that can be used. As a result, it follows that higher relative temperatures would tend to make the reaction conditions more stringent, while lower temperatures less so. For additional details and explanation of stringency of hybridization reactions, see Ausubel et al., Current Protocols in Molecular Biology, Wiley Interscience Publishers, (1995).

"Stringent conditions" or "high stringency conditions", as defined herein, are identified by, but not limited to, those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 μg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C. "Moderately stringent conditions" are described by, but not limited to, those in Sambrook et al., Molecular Cloning: A Laboratory Manual, New York: Cold Spring Harbor Press, 1989, and include the use of washing solution and hybridization conditions (e.g., temperature, ionic strength and %SDS) less stringent than those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5× Denhardt's solution, 10% dextran sulfate, and 20 mg/mL denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

An HLA "supermotif" is a peptide binding specificity shared by HLA molecules encoded by two or more HLA alleles.

As used herein "to treat" or "therapeutic" and grammatically related terms, refer to any improvement of any consequence of disease, such as prolonged survival, less morbidity, and/or a lessening of side effects which are the byproducts of an alternative therapeutic modality; full eradication of disease is not required.

A "transgenic animal" (e.g., a mouse or rat) is an animal having cells that contain a transgene, which transgene was introduced into the animal or an ancestor of the animal at a prenatal, e.g., an embryonic stage. A "transgene" is a DNA that is integrated into the genome of a cell from which a transgenic animal develops.

As used herein, an HLA or cellular immune response "vaccine" is a composition that contains or encodes one or more peptides of the invention. There are numerous embodiments of such vaccines, such as a cocktail of one or more individual peptides; one or more peptides of the invention comprised by a polyepitopic peptide; or nucleic acids that encode such individual peptides or polypeptides, e.g., a minigene that encodes a polyepitopic peptide. The "one or more peptides" can include any whole unit integer from 1-150 or more, e.g., at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 105, 110, 115, 120, 125, 130, 135, 140, 145, or 150 or more peptides of the invention. The peptides or polypeptides can optionally be modified, such as by lipidation, addition of targeting or other sequences. HLA class I peptides of the invention can be admixed with, or linked to, HLA class II peptides, to facilitate activation of both cytotoxic T lymphocytes and helper T lymphocytes. HLA vaccines can also comprise peptide-pulsed antigen presenting cells, e.g., dendritic cells.

The term "variant" refers to a molecule that exhibits a variation from a described type or norm, such as a protein that has one or more different amino acid residues in the corresponding position(s) of a specifically described protein (e.g. the 193P1E1B protein shown in FIG. 2 or FIG. 3. An analog is an example of a variant protein. Splice isoforms and single nucleotides polymorphisms (SNPs) are further examples of variants.

The "193P1E1B-related proteins" of the invention include those specifically identified herein, as well as allelic variants, conservative substitution variants, analogs and homologs that can be isolated/generated and characterized without undue experimentation following the methods outlined herein or readily available in the art. Fusion proteins that combine parts of different 193P1E1B proteins or fragments thereof, as well as fusion proteins of a 193P1E1B protein and a heterologous polypeptide are also included. Such 193P1E1B proteins are collectively referred to as the 193P1E1B-related proteins, the proteins of the invention, or 193P1E1B. The term "193P1E1B-related protein" refers to a polypeptide fragment or an 193P1E1B protein sequence of 4, 5, 6, 7, 8, 9, 10, 11, 12, 13, 14, 15, 16, 17, 18, 19, 20, 21, 22, 23, 24, 25, or more than 25 amino acids; or, at least 30, 35, 40, 45, 50, 55, 60, 65, 70, 80, 85, 90, 95, 100 or more than 100 amino acids.

II.) 193P1E1B Polynucleotides

One aspect of the invention provides polynucleotides corresponding or complementary to all or part of an 193P1E1B gene, mRNA, and/or coding sequence, preferably in isolated form, including polynucleotides encoding an 193P1E1B-related protein and fragments thereof, DNA, RNA, DNA/RNA hybrid, and related molecules, polynucleotides or oligonucleotides complementary to an 193P1E1B gene or mRNA sequence or a part thereof, and polynucleotides or oligonucleotides that hybridize to an 193P1E1B gene, mRNA, or to an 193P1E1B encoding polynucleotide (collectively, "193P1E1B polynucleotides"). In all instances when referred to in this section, T can also be U in FIG. 2.

Embodiments of a 193P1E1B polynucleotide include: a 193P1E1B polynucleotide having the sequence shown in FIG. 2, the nucleotide sequence of 193P1E1B as shown in FIG. 2 wherein T is U; at least 10 contiguous nucleotides of a polynucleotide having the sequence as shown in FIG. 2; or, at least 10 contiguous nucleotides of a polynucleotide having the sequence as shown in FIG. 2 where T is U. For example, embodiments of 193P1E1B nucleotides comprise, without limitation:

(I) a polynucleotide comprising, consisting essentially of, or consisting of a sequence as shown in FIG. 2A (SEQ ID NO.: 1308), wherein T can also be U;

(II) a polynucleotide comprising, consisting essentially of, or consisting of the sequence as shown in FIG. 2A (SEQ ID NO.: 1308), from nucleotide residue number 805 through nucleotide residue number 2043, wherein T can also be U;

(III) a polynucleotide comprising, consisting essentially of, or consisting of the sequence as shown in FIG. 2B (SEQ ID NO.: 2984), from nucleotide residue number 805 through nucleotide residue number 2043, wherein T can also be U;

(IV) a polynucleotide comprising, consisting essentially of, or consisting of the sequence as shown in FIG. 2C (SEQ ID NO.: 2986), from nucleotide residue number 185 through nucleotide residue number 1177, wherein T can also be U;

(V) a polynucleotide comprising, consisting essentially of, or consisting of the sequence as shown in FIG. 2D (SEQ ID NO.: 1311), from nucleotide residue number 805 through nucleotide residue number 1971, wherein T can also be U;

(VI) a polynucleotide comprising, consisting essentially of, or consisting of the sequence as shown in FIG. 2E (SEQ ID NO.: 1314), from nucleotide residue number 989 through nucleotide residue number 1909, wherein T can also be U;

(VII) a polynucleotide comprising, consisting essentially of, or consisting of the sequence as shown in FIG. 2F (SEQ ID NO.: 1316), from nucleotide residue number 805 through nucleotide residue number 1026, wherein T can also be U;

(VIII) a polynucleotide that encodes an 193P1E1B-related protein that is at least 90% homologous to an entire amino acid sequence shown in FIGS. 2A-F (SEQ ID NOS.: 1308, 2984, 2986, 1311, 1314, and 1316);

(IX) a polynucleotide that encodes an 193P1E1B-related protein that is at least 90% identical to an entire amino acid sequence shown in FIGS. 2A-F (SEQ ID NOS: 2983, 2985, 1310, 1313, 1315, and 1317);

(X) a polynucleotide that encodes at least one peptide set forth in Tables V-XVIII, XXVI, and XXVII;

(XI) a polynucleotide that encodes a peptide region of at least 5 amino acids of a peptide of FIG. 3A or 3B in any whole number increment up to 412 that includes an amino acid position having a value greater than 0.5 in the Hydrophilicity profile of FIG. 5;

(XII) a polynucleotide that encodes a peptide region of at least 5 amino acids of a peptide of FIG. 3A or 3B in any whole number increment up to 412 that includes an amino acid position having a value less than 0.5 in the Hydropathicity profile of FIG. 6;

(XIII) a polynucleotide that encodes a peptide region of at least 5 amino acids of a peptide of FIG. 3A or 3B in any whole number increment up to 412 that includes an amino acid position having a value greater than 0.5 in the Percent Accessible Residues profile of FIG. 7;

(XIV) a polynucleotide that encodes a peptide region of at least 5 amino acids of a peptide of FIG. 3A or 3B in any whole number increment up to 412 that includes an amino acid position having a value greater than 0.5 in the Average Flexibility profile on FIG. 8;

(XV) a polynucleotide that encodes a peptide region of at least 5 amino acids of a peptide of FIG. 3A or 3B in any whole number increment up to 412 that includes an amino acid position having a value greater than 0.5 in the Beta-turn profile of FIG. 9;

(XVI) a polynucleotide that encodes a peptide region of at least 5 amino acids of a peptide of FIG. 3C in any whole number increment up to 330 that includes an amino acid position having a value greater than 0.5 in the Hydrophilicity profile of FIG. 5;

(XVII) a polynucleotide that encodes a peptide region of at least 5 amino acids of a peptide of FIG. 3C in any whole number increment up to 330 that includes an amino acid position having a value less than 0.5 in the Hydropathicity profile of FIG. 6;

(XVIII) a polynucleotide that encodes a peptide region of at least 5 amino acids of a peptide of FIG. 3C in any whole number increment up to 330 that includes an amino acid position having a value greater than 0.5 in the Percent Accessible Residues profile of FIG. 7;

(XIX) a polynucleotide that encodes a peptide region of at least 5 amino acids of a peptide of FIG. 3C in any whole number increment up to 330 that includes an amino acid position having a value greater than 0.5 in the Average Flexibility profile on FIG. 8;

(XX) a polynucleotide that encodes a peptide region of at least 5 amino acids of a peptide of FIG. 3C in any whole number increment up to 330 that includes an amino acid position having a value greater than 0.5 in the Beta-turn profile of FIG. 9;

(XXI) a polynucleotide that encodes a peptide region of at least 5 amino acids of a peptide of FIG. 3D in any whole number increment up to 388 that includes an amino acid position having a value greater than 0.5 in the Hydrophilicity profile of FIG. 5;

(XXII) a polynucleotide that encodes a peptide region of at least 5 amino acids of a peptide of FIG. 3D in any whole number increment up to 388 that includes an amino acid position having a value less than 0.5 in the Hydropathicity profile of FIG. 6;

(XXIII) a polynucleotide that encodes a peptide region of at least 5 amino acids of a peptide of FIG. 3D in any whole number increment up to 388 that includes an amino acid position having a value greater than 0.5 in the Percent Accessible Residues profile of FIG. 7;

(XXIV) a polynucleotide that encodes a peptide region of at least 5 amino acids of a peptide of FIG. 3D in any whole number increment up to 388 that includes an amino acid position having a value greater than 0.5 in the Average Flexibility profile on FIG. 8;

(XXV) a polynucleotide that encodes a peptide region of at least 5 amino acids of a peptide of FIG. 3D in any whole number increment up to 388 that includes an amino acid position having a value greater than 0.5 in the Beta-turn profile of FIG. 9;

(XXVI) a polynucleotide that encodes a peptide region of at least 5 amino acids of a peptide of FIG. 3E in any whole number increment up to 236 that includes an amino acid position having a value greater than 0.5 in the Hydrophilicity profile of FIG. 5;

(XXVII) a polynucleotide that encodes a peptide region of at least 5 amino acids of a peptide of FIG. 3E in any whole number increment up to 236 that includes an amino acid position having a value less than 0.5 in the Hydropathicity profile of FIG. 6;

(XXVIII) a polynucleotide that encodes a peptide region of at least 5 amino acids of a peptide of FIG. 3E in any whole number increment up to 236 that includes an amino acid position having a value greater than 0.5 in the Percent Accessible Residues profile of FIG. 7;

(XXIX) a polynucleotide that encodes a peptide region of at least 5 amino acids of a peptide of FIG. 3E in any whole number increment up to 236 that includes an amino acid position having a value greater than 0.5 in the Average Flexibility profile on FIG. 8;

(XXX) a polynucleotide that encodes a peptide region of at least 5 amino acids of a peptide of FIG. 3E in any whole number increment up to 236 that includes an amino acid position having a value greater than 0.5 in the Beta-turn profile of FIG. 9;

(XXXI) a polynucleotide that encodes a peptide region of at least 5 amino acids of a peptide of FIG. 3F in any whole number increment up to 73 that includes an amino acid position having a value greater than 0.5 in the Hydrophilicity profile of FIG. 5;

(XXXII) a polynucleotide that encodes a peptide region of at least 5 amino acids of a peptide of FIG. 3F in any whole number increment up to 73 that includes an amino acid position having a value less than 0.5 in the Hydropathicity profile of FIG. 6;

(XXXIII) a polynucleotide that encodes a peptide region of at least 5 amino acids of a peptide of FIG. 3F in any whole number increment up to 73 that includes an amino acid position having a value greater than 0.5 in the Percent Accessible Residues profile of FIG. 7;

(XXXIV) a polynucleotide that encodes a peptide region of at least 5 amino acids of a peptide of FIG. 3F in any whole number increment up to 73 that includes an amino acid position having a value greater than 0.5 in the Average Flexibility profile on FIG. 8;

(XXXV) a polynucleotide that encodes a peptide region of at least 5 amino acids of a peptide of FIG. 3F in any whole number increment up to 73 that includes an amino acid position having a value greater than 0.5 in the Beta-turn profile of FIG. 9;

(XXXVI) a polynucleotide that encodes a 193P1E1B-related protein whose sequence is encoded by the cDNAs contained in the plasmid designated p193P1E1B-V.1 deposited with American Type Culture Collection as Accession No. PTA-3815;

(XXXVII) a polynucleotide that encodes a 193P1E1B-related protein whose sequence is encoded by the cDNAs contained in the plasmid designated 193P1E1B-V.2 deposited with American Type Culture Collection as Accession No. PTA-3816;

(XXXVIII) a polynucleotide that encodes a 193P1E1B-related protein whose sequence is encoded by the cDNAs contained in the plasmid designated 193P1E1B-V.3 deposited with American Type Culture Collection as Accession No. PTA-3817;

(XXXIX) a polynucleotide that is fully complementary to a polynucleotide of any one of (I)-(XXXVIII);

(XL) a polynucleotide that selectively hybridizes under stringent conditions to a polynucleotide of (I)-(XXXIX);

(XLI) a peptide that is encoded by any of (I)-(XXXVIII); and, (XLII) a polynucleotide of any of (I)-(XL) or peptide of (XLI) together with a pharmaceutical excipient and/or in a human unit dose form.

As used herein, a range is understood to specifically disclose all whole unit positions thereof.

Typical embodiments of the invention disclosed herein include 193P1E1B polynucleotides that encode specific portions of 193P1E1B mRNA sequences (and those which are complementary to such sequences) such as those that encode the proteins and/or fragments thereof, for example:

(a) 4, 5,6,7, 8,9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 250, 275, 300, 325, 350, 375, 400, or 412 contiguous amino acids of variants 1 or 2;

(b) 4, 5, 6, 7, 8,9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 250, 275, 300, 325, or 330 contiguous amino acids of variant 3;

(c) 4, 5,6,7, 8,9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 250, 275, 300, 325, 350, 375, or 388 contiguous amino acids of variant 4;

(d) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, or 236 contiguous amino acids of variant 5; or, (e) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, or 73 contiguous amino acids of variant 6.

For example, representative embodiments of the invention disclosed herein include: polynucleotides and their encoded peptides themselves encoding about amino acid 1 to about amino acid 10 of the 193P1E1B protein shown in FIG. 2 or FIG. 3, polynucleotides encoding about amino acid 10 to about amino acid 20 of the 193P1E1B protein shown in FIG. 2, or FIG. 3, polynucleotides encoding about amino acid 20 to about amino acid 30 of the 193P1E1B protein shown in FIG. 2 or FIG. 3, polynucleotides encoding about amino acid 30 to about amino acid 40 of the 193P1E1B protein shown in FIG. 2 or FIG. 3, polynucleotides encoding about amino acid 40 to about amino acid 50 of the 193P1E1B protein shown in FIG. 2 or FIG. 3, polynucleotides encoding about amino acid 50 to about amino acid 60 of the 193P1E1B protein shown in FIG. 2 or FIG. 3, polynucleotides encoding about amino acid 60 to about amino acid 70 of the 193P1E1B protein shown in FIG. 2 or FIG. 3, polynucleotides encoding about amino acid 70 to about amino acid 80 of the 193P1E1B protein shown in FIG. 2 or FIG. 3, polynucleotides encoding about amino acid 80 to about amino acid 90 of the 193P1E1B protein shown in FIG. 2 or FIG. 3, polynucleotides encoding about amino acid 90 to about amino acid 100 of the 193P1E1B protein shown in FIG. 2 or FIG. 3, in increments of about 10 amino acids, ending at the carboxyl terminal amino acid set forth in FIG. 2 or FIG. 3. Accordingly polynucleotides encoding portions of the amino acid sequence (of about 10 amino acids), of amino acids 100 through the carboxyl terminal amino acid of the 193P1E1B protein are embodiments of the invention. Wherein it is understood that each particular amino acid position discloses that position plus or minus five amino acid residues.

Polynucleotides encoding relatively long portions of a 193P1E1B protein are also within the scope of the invention. For example, polynucleotides encoding from about amino acid 1 (or 20 or 30 or 40 etc.) to about amino acid 20, (or 30, or 40 or 50 etc.) of the 193P1E1B protein shown in FIG. 2 or FIG. 3 can be generated by a variety of techniques well known in the art. These polynucleotide fragments can include any portion of the 193P1E1B sequence as shown in FIG. 2.

Additional illustrative embodiments of the invention disclosed herein include 193P1E1B polynucleotide fragments encoding one or more of the biological motifs contained within a 193P1E1B protein sequence, including one or more of the motif-bearing subsequences of a 193P1E1B protein set forth in Tables V-XVIII, XXVI, and XXVII. In another embodiment, typical polynucleotide fragments of the invention encode one or more of the regions of 193P1E1B that exhibit homology to a known molecule. In another embodiment of the invention, typical polynucleotide fragments can encode one or more of the 193P1E1B N-glycosylation sites, cAMP and cGMP-dependent protein kinase phosphorylation sites, casein kinase II phosphorylation sites or N-myristoylation site and amidation sites.

II.A.) Uses of 193P1E1B Polynucleotides

II.A.1.) Monitoring of Genetic Abnormalities

The polynucleotides of the preceding paragraphs have a number of different specific uses. The human 193P1E1B gene maps to the chromosomal location set forth in Example 3. For example, because the 193P1E1B gene maps to this chromosome, polynucleotides that encode different regions of the 193P1E1B proteins are used to characterize cytogenetic abnormalities of this chromosomal locale, such as abnormalities that are identified as being associated with various cancers. In certain genes, a variety of chromosomal abnormalities including rearrangements have been identified as frequent cytogenetic abnormalities in a number of different cancers (see e.g. Krajinovic et al., Mutat. Res. 382(3-4): 81-83 (1998); Johansson et al., Blood 86(10): 3905-3914 (1995) and Finger et al., P.N.A.S. 85(23): 9158-9162 (1988)). Thus, polynucleotides encoding specific regions of the 193P1E1B proteins provide new tools that can be used to delineate, with greater precision than previously possible, cytogenetic abnormalities in the chromosomal region that encodes 193P1E1B that may contribute to the malignant phenotype. In this context, these polynucleotides satisfy a need in the art for expanding the sensitivity of chromosomal screening in order to identify more subtle and less common chromosomal abnormalities (see e.g. Evans et al., Am. J. Obstet. Gynecol 171(4): 1055-1057 (1994)).

Furthermore, as 193P1E1B was shown to be highly expressed in bladder and other cancers, 193P1E1B polynucleotides are used in methods assessing the status of 193P1E1B gene products in normal versus cancerous tissues. Typically, polynucleotides that encode specific regions of the 193P1E1B proteins are used to assess the presence of perturbations (such as deletions, insertions, point mutations, or alterations resulting in a loss of an antigen etc.) in specific regions of the 193P1E1B gene, such as regions containing one or more motifs. Exemplary assays include both RT-PCR assays as well as single-strand conformation polymorphism (SSCP) analysis (see, e.g., Marrogi et al., J. Cutan. Pathol. 26(8): 369-378 (1999), both of which utilize polynucleotides encoding specific regions of a protein to examine these regions within the protein.

II.A.2.) Antisense Embodiments

Other specifically contemplated nucleic acid related embodiments of the invention disclosed herein are genomic DNA, cDNAs, ribozymes, and antisense molecules, as well as nucleic acid molecules based on an alternative backbone, or including alternative bases, whether derived from natural sources or synthesized, and include molecules capable of inhibiting the RNA or protein expression of 193P1E1B. For example, antisense molecules can be RNAs or other molecules, including peptide nucleic acids (PNAs) or non-nucleic acid molecules such as phosphorothioate derivatives, that specifically bind DNA or RNA in a base pair-dependent manner. A skilled artisan can readily obtain these classes of nucleic acid molecules using the 193P1E1B polynucleotides and polynucleotide sequences disclosed herein.

Antisense technology entails the administration of exogenous oligonucleotides that bind to a target polynucleotide located within the cells. The term "antisense" refers to the fact that such oligonucleotides are complementary to their intracellular targets, e.g., 193P1E1B. See for example, Jack Cohen, Oligodeoxynucleotides, Antisense Inhibitors of Gene Expression, CRC Press, 1989; and Synthesis 1:1-5 (1988). The 193P1E1B antisense oligonucleotides of the present invention include derivatives such as S-oligonucleotides (phosphorothioate derivatives or S-oligos, see, Jack Cohen, supra), which exhibit enhanced cancer cell growth inhibitory action. S-oligos (nucleoside phosphorothioates) are isoelectronic analogs of an oligonucleotide (O-oligo) in which a nonbridging oxygen atom of the phosphate group is replaced by a sulfur atom. The S-oligos of the present invention can be prepared by treatment of the corresponding O-oligos with 3H-1,2-benzodithiol-3-one-1,1-dioxide, which is a sulfur transfer reagent. See, e.g., Iyer, R. P. et al., J. Org. Chem. 55:4693-4698 (1990); and Iyer, R. P. et al., J. Am. Chem. Soc. 112:1253-1254 (1990). Additional 193P1E1B antisense oligonucleotides of the present invention include morpholino antisense oligonucleotides known in the art (see, e.g., Partridge et al., 1996, Antisense & Nucleic Acid Drug Development 6: 169-175).

The 193P1E1B antisense oligonucleotides of the present invention typically can be RNA or DNA that is complementary to and stably hybridizes with the first 100 5' codons or last 100 3' codons of a 193P1E1B genomic sequence or the corresponding mRNA. Absolute complementarity is not required, although high degrees of complementarity are preferred. Use of an oligonucleotide complementary to this region allows for the selective hybridization to 193P1E1B mRNA and not to mRNA specifying other regulatory subunits of protein kinase. In one embodiment, 193P1E1B antisense oligonucleotides of the present invention are 15 to 30-mer fragments of the antisense DNA molecule that have a sequence that hybridizes to 193P1E1B mRNA. Optionally, 193P1E1B antisense oligonucleotide is a 30-mer oligonucleotide that is complementary to a region in the first 10 5' codons or last 10 3' codons of 193P1E1B. Alternatively, the antisense molecules are modified to employ ribozymes in the inhibition of 193P1E1B expression, see, e.g., L. A. Couture & D. T. Stinchcomb; *Trends Genet* 12: 510-515 (1996).

II.A.3.) Primers and Primer Pairs

Further specific embodiments of this nucleotides of the invention include primers and primer pairs, which allow the specific amplification of polynucleotides of the invention or of any specific parts thereof, and probes that selectively or specifically hybridize to nucleic acid molecules of the invention or to any part thereof. Probes can be labeled with a detectable marker, such as, for example, a radioisotope, fluorescent compound, bioluminescent compound, a chemiluminescent compound, metal chelator or enzyme. Such probes and primers are used to detect the presence of a 193P1E1B polynucleotide in a sample and as a means for detecting a cell expressing a 193P1E1B protein.

Examples of such probes include polypeptides comprising all or part of the human 193P1E1B cDNA sequence shown in FIG. 2. Examples of primer pairs capable of specifically amplifying 193P1E1B mRNAs are also described in the Examples. As will be understood by the skilled artisan, a great many different primers and probes can be prepared based on the sequences provided herein and used effectively to amplify and/or detect a 193P1E1B mRNA.

The 193P1E1B polynucleotides of the invention are useful for a variety of purposes, including but not limited to their use as probes and primers for the amplification and/or detection of the 193P1E1B gene(s), mRNA(s), or fragments thereof; as reagents for the diagnosis and/or prognosis of prostate cancer and other cancers; as coding sequences capable of directing the expression of 193P1E1B polypeptides; as tools for modulating or inhibiting the expression of the 193P1E1B gene(s) and/or translation of the 193P1E1B transcript(s); and as therapeutic agents.

The present invention includes the use of any probe as described herein to identify and isolate a 193P1E1B or 193P1E1B related nucleic acid sequence from a naturally occurring source, such as humans or other mammals, as well as the isolated nucleic acid sequenceper se, which would comprise all or most of the sequences found in the probe used.

II.A.4.) Isolation of 193P1E1B-Encoding Nucleic Acid Molecules

The 193P1E1B cDNA sequences described herein enable the isolation of other polynucleotides encoding 193P1E1B gene product(s), as well as the isolation of polynucleotides encoding 193P1E1B gene product homologs, alternatively spliced isoforms, allelic variants, and mutant forms of a 193P1E1B gene product as well as polynucleotides that encode analogs of 193P1E1B-related proteins. Various molecular cloning methods that can be employed to isolate full length cDNAs encoding an 193P1E1B gene are well known (see, for example, Sambrook, J. et al., Molecular Cloning: A Laboratory Manual, 2d edition, Cold Spring Harbor Press, New York, 1989; Current Protocols in Molecular Biology. Ausubel et al., Eds., Wiley and Sons, 1995). For example, lambda phage cloning methodologies can be conveniently employed, using commercially available cloning systems (e.g., Lambda ZAP Express, Stratagene). Phage clones containing 193P1E1B gene cDNAs can be identified by probing with a labeled 193P1E1B cDNA or a fragment thereof. For example, in one embodiment, a 193P1E1B cDNA (e.g., FIG. 2) or a portion thereof can be synthesized and used as a probe to retrieve overlapping and full-length cDNAs corresponding to a 193P1E1B gene. A 193P1E1B gene itself can be isolated by screening genomic DNA libraries, bacterial artificial chromosome libraries (BACs), yeast artificial chromosome libraries (YACs), and the like, with 193P1E1B DNA probes or primers.

II.A.5.) Recombinant Nucleic Acid Molecules and Host-Vector Systems

The invention also provides recombinant DNA or RNA molecules containing an 193P1E1B polynucleotide, a fragment, analog or homologue thereof, including but not limited to phages, plasmids, phagemids, cosmids, YACs, BACs, as well as various viral and non-viral vectors well known in the art, and cells transformed or transfected with such recombinant DNA or RNA molecules. Methods for generating such molecules are well known (see, for example, Sambrook et al., 1989, supra).

The invention further provides a host-vector system comprising a recombinant DNA molecule containing a 193P1E1B polynucleotide, fragment, analog or homologue thereof within a suitable prokaryotic or eukaryotic host cell. Examples of suitable eukaryotic host cells include a yeast cell, a plant cell, or an animal cell, such as a mammalian cell or an insect cell (e.g., a baculovirus-infectible cell such as an Sf9 or HighFive cell). Examples of suitable mammalian cells include various prostate cancer cell lines such as DU145 and TsuPr1, other transfectable or transducible prostate cancer cell lines, primary cells (PrEC), as well as a number of mammalian cells routinely used for the expression of recombinant proteins (e.g., COS, CHO, 293, 293T cells). More particularly, a polynucleotide comprising the coding sequence of 193P1E1B or a fragment, analog or homolog thereof can be used to generate 193P1E1B proteins or fragments thereof using any number of host-vector systems routinely used and widely known in the art.

A wide range of host-vector systems suitable for the expression of 193P1E1B proteins or fragments thereof are available, see for example, Sambrook et al., 1989, supra; Current Protocols in Molecular Biology, 1995, supra). Preferred vectors for mammalian expression include but are not limited to pcDNA 3.1 myc-His-tag (Invitrogen) and the retroviral vector pSRαtkneo (Muller et al., 1991, MCB 11:1785). Using these expression vectors, 193P1E1B can be expressed in several prostate cancer and non-prostate cell lines, including for example 293, 293T, rat-1, NIH 3T3 and TsuPr1. The host-vector systems of the invention are useful for the production of a 193P1E1B protein or fragment thereof. Such host-vector systems can be employed to study the functional properties of 193P1E1B and 193P1E1B mutations or analogs.

Recombinant human 193P1E1B protein or an analog or homolog or fragment thereof can be produced by mammalian cells transfected with a construct encoding a 193P1E1B-related nucleotide. For example, 293T cells can be transfected with an expression plasmid encoding 193P1E1B or fragment, analog or homolog thereof, a 193P1E1B-related protein is expressed in the 293T cells, and the recombinant 193P1E1B protein is isolated using standard purification methods (e.g., affinity purification using anti-193P1E1B antibodies). In another embodiment, a 193P1E1B coding sequence is subcloned into the retroviral vector pSRαMSVtkneo and used to infect various mammalian cell lines, such as NIH 3T3, TsuPr1, 293 and rat-1 in order to establish 193P1E1B expressing cell lines. Various other expression systems well known in the art can also be employed. Expression constructs encoding a leader peptide joined in frame to a 193P1E1B coding sequence can be used for the generation of a secreted form of recombinant 193P1E1B protein.

As discussed herein, redundancy in the genetic code permits variation in 193P1E1B gene sequences. In particular, it is known in the art that spefic host species often have spefic codon preferences, and thus one can adapt the disclosed sequence as preferred for a desired host. For example, preferred analog condon sequences typically have rare condons (i.e., condons having a usage frequency of loss than about 20% in known sequences of the desired host) replaced with higher frequency condons. Condon preferences for a spefic species are calculated, for example, by utilizing condon usage tables available on the INTERNET.

Additional sequence modifications are known to enhance protein expression in a cellular host. These include elimination of sequences encoding spurious polyadenylation signals, exon/intron splice site signals, transposon-like repeats, and/or other such well-characterized sequences that are deleterious to gene expression. The GC content of the sequence is adjusted to levels average for a given cellular host, as calculated by reference to known genes expressed in the host cell. Where possible, the sequence is modified to avoid predicted hairpin secondary mRNA structures. Other useful modifications include the addition of a translational initiation consensus sequence at the start of the open reading frame, as described in Kozak, *Mol Cell Biol.,* 9:5073-5080 (1989). Skilled artisans understand that the general rule that eukaryotic ribosomes initiate translation exclusively at the 5' proximal AUG codon is abrogated only under rare conditions (see, e.g., Kozak PNAS 92(7): 2662-2666, (1995) and Kozak NAR 15(20): 8125-8148 (1987)).

III.) 193P1E1B-related Proteins

Another aspect of the present invention provides 193P1E1B-related proteins. Specific embodiments of 193P1E1B proteins comprise a polypeptide having all or part of the amino acid sequence of human 193P1E1B as shown in FIG. 2 or FIG. 3. Alternatively, embodiments of 193P1E1B proteins comprise variant, homolog or analog polypeptides that have alterations in the amino acid sequence of 193P1E1B shown in FIG. 2 or FIG. 3.

In general, naturally occurring allelic variants of human 193P1E1B share a high degree of structural identity and homology (e.g., 90% or more homology). Typically, allelic variants of a 193P1E1B protein contain conservative amino acid substitutions within the 193P1E1B sequences described herein or contain a substitution of an amino acid from a corresponding position in a homologue of 193P1E1B. One class of 193P1E1B allelic variants are proteins that share a high degree of homology with at least a small region of a particular 193P1E1B amino acid sequence, but further contain a radical departure from the sequence, such as a non-conservative substitution, truncation, insertion or frame shift. In comparisons of protein sequences, the terms, similarity, identity, and homology each have a distinct meaning as appreciated in the field of genetics. Moreover, orthology and paralogy can be important concepts describing the relationship of members of a given protein family in one organism to the members of the same family in other organisms.

Amino acid abbreviations are provided in Table II. Conservative amino acid substitutions can frequently be made in a protein without altering either the conformation or the function of the protein. Proteins of the invention can comprise 1, 2, 3, 4, 5, 6, 7, 8, 9, 10, 11, 12, 13, 14, 15 conservative substitutions. Such changes include substituting any of isoleucine (I), valine (V), and leucine (L) for any other of these hydrophobic amino acids; aspartic acid (D) for glutamic acid (E) and vice versa; glutamine (O) for asparagine (N) and vice versa; and serine (S) for threonine (T) and vice versa. Other substitutions can also be considered conservative, depending on the environment of the particular amino acid and its role in the three-dimensional structure of the protein. For example, glycine (G) and alanine (A) can frequently be interchangeable, as can alanine (A) and valine (V). Methionine (M), which is relatively hydrophobic, can frequently be interchanged with leucine and isoleucine, and sometimes with valine. Lysine (K) and arginine (R) are frequently interchangeable in locations in which the significant feature of the amino acid residue is its charge and the differing pK's of these two amino acid residues are not significant. Still other changes can be considered "conservative" in particular environments (see, e.g. Table III herein; pages 13-15 "Biochemistry" $2^{nd}$ED. Lubert Stryer ed (Stanford University); Henikoff et al., PNAS 1992 Vol 89 10915-10919; Lei et al., J Biol Chem 1995 May 19; 270(20):11882-6).

Embodiments of the invention disclosed herein include a wide variety of art-accepted variants or analogs of 193P1E1B proteins such as polypeptides having amino acid insertions, deletions and substitutions. 193P1E1B variants can be made using methods known in the art such as site-directed mutagenesis, alanine scanning, and PCR mutagenesis. Site-directed mutagenesis (Carter et al., *Nucl. Acids Res.,* 13:4331 (1986); Zoller et al., *Nucl. Acids Res.,* 10:6487 (1987)), cassette mutagenesis (Wells et al., Gene, 34:315 (1985)), restriction selection mutagenesis (Wells et al., *Philos. Trans. R. Soc. London SerA,* 317:415 (1986)) or other known techniques can be performed on the cloned DNA to produce the 193P1E1B variant DNA.

Scanning amino acid analysis can also be employed to identify one or more amino acids along a contiguous sequence that is involved in a specific biological activity such as a protein-protein interaction. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant. Alanine is also typically preferred because it is the most common amino acid. Further, it is frequently found in both buried and exposed positions (Creighton, *The Proteins*, (W. H. Freeman & Co., N.Y.); Chothia, J. Mol. Biol., 150:1 (1976)). If alanine substitution does not yield adequate amounts of variant, an isosteric amino acid can be used.

As defined herein, 193P1E1B variants, analogs or homologs, have the distinguishing attribute of having at least one epitope that is "cross reactive" with a 193P1E1B protein having an amino acid sequence of FIG. 3. As used in this sentence, "cross reactive" means that an antibody or T cell that specifically binds to an 193P1E1B variant also specifically binds to a 193P1E1B protein having an amino acid sequence set forth in FIG. 3. A polypeptide ceases to be a variant of a protein shown in FIG. 3, when it no longer contains any epitope capable of being recognized by an antibody or T cell that specifically binds to the starting 193P1E1B protein. Those skilled in the art understand that antibodies that recognize proteins bind to epitopes of varying size, and a grouping of the order of about four or five amino acids, contiguous or not, is regarded as a typical number of amino acids in a minimal epitope. See, e.g., Nair et al., J. Immunol 2000 165(12): 6949-6955; Hebbes et al., Mol Immunol (1989) 26(9):865-73; Schwartz et al., J Immunol (1985) 135 (4):2598-608.

Other classes of 193P1E1B-related protein variants share 70%, 75%, 80%, 85% or 90% or more similarity with an amino acid sequence of FIG. 3, or a fragment thereof. Another specific class of 193P1E1B protein variants or analogs comprise one or more of the 193P1E1B biological motifs described herein or presently known in the art. Thus, encompassed by the present invention are analogs of 193P1E1B fragments (nucleic or amino acid) that have altered functional (e.g. immunogenic) properties relative to the starting fragment. It is to be appreciated that motifs now or which become part of the art are to be applied to the nucleic or amino acid sequences of FIG. 2 or FIG. 3.

As discussed herein, embodiments of the claimed invention include polypeptides containing less than the full amino acid sequence of a 193P1E1B protein shown in FIG. 2 or FIG. 3. For example, representative embodiments of the invention comprise peptides/proteins having any 4, 5, 6, 7, 8, 9, 10, 11, 12, 13, 14, 15 or more contiguous amino acids of a 193P1E1B protein shown in FIG. 2 or FIG. 3.

Moreover, representative embodiments of the invention disclosed herein include polypeptides consisting of about amino acid 1 to about amino acid 10 of a 193P1E1B protein shown in FIG. 2 or FIG. 3, polypeptides consisting of about amino acid 10 to about amino acid 20 of a 193P1E1B protein shown in FIG. 2 or FIG. 3, polypeptides consisting of about amino acid 20 to about amino acid 30 of a 193P1E1B protein shown in FIG. 2 or FIG. 3, polypeptides consisting of about amino acid 30 to about amino acid 40 of a 193P1E1B protein shown in FIG. 2 or FIG. 3, polypeptides consisting of about amino acid 40 to about amino acid 50 of a 193P1E1B protein shown in FIG. 2 or FIG. 3, polypeptides consisting of about amino acid 50 to about amino acid 60 of a 193P1E1B protein shown in FIG. 2 or FIG. 3, polypeptides consisting of about amino acid 60 to about amino acid 70 of a 193P1E1B protein shown in FIG. 2 or FIG. 3, polypeptides consisting of about amino acid 70 to about amino acid 80 of a 193P1E1B protein shown in FIG. 2 or FIG. 3, polypeptides consisting of about amino acid 80 to about amino acid 90 of a 193P1E1B protein shown in FIG. 2 or FIG. 3, polypeptides consisting of about amino acid 90 to about amino acid 100 of a 193P1E1B protein shown in FIG. 2 or FIG. 3, etc. throughout the entirety of a 193P1E1B amino acid sequence. Moreover, polypeptides consisting of about amino acid 1 (or 20 or 30 or 40 etc.) to about amino acid 20, (or 130, or 140 or 150 etc.) of a 193P1E1B protein shown in FIG. 2 or FIG. 3 are embodiments of the invention. It is to be appreciated that the starting and stopping positions in this paragraph refer to the specified position as well as that position plus or minus 5 residues.

193P1E1B-related proteins are generated using standard peptide synthesis technology or using chemical cleavage methods well known in the art. Alternatively, recombinant methods can be used to generate nucleic acid molecules that encode a 193P1E1B-related protein. In one embodiment, nucleic acid molecules provide a means to generate defined fragments of a 193P1E1B protein (or variants, homologs or analogs thereof).

III.A.) Motif-Bearing Protein Embodiments

Additional illustrative embodiments of the invention disclosed herein include 193P1E1B polypeptides comprising the amino acid residues of one or more of the biological motifs contained within a 193P1E1B polypeptide sequence set forth in FIG. 2 or FIG. 3. Various motifs are known in the art, and a protein can be evaluated for the presence of such motifs by a number of publicly available Internet sites (see, e.g., Epimatrix™ and Epimer™, Brown University, and BIMAS.

Motif bearing subsequences of all 193P1E1B variant proteins are set forth and identified in Table XIX.

Table XX sets forth several frequently occurring motifs based on pfam searches (see URL address pfam.wustl.edu/). The columns of Table XX list (1) motif name abbreviation, (2) percent identity found amongst the different member of the motif family, (3) motif name or description and (4) most common function; location information is included if the motif is relevant for location.

Polypeptides comprising one or more of the 193P1E1B motifs discussed above are useful in elucidating the specific characteristics of a malignant phenotype in view of the observation that the 193P1E1B motifs discussed above are associated with growth dysregulation and because 193P1E1B is overexpressed in certain cancers (See, e.g., Table I). Casein kinase II, cAMP and camp-dependent protein kinase, and Protein Kinase C, for example, are enzymes known to be associated with the development of the malignant phenotype (see e.g. Chen et al., Lab Invest., 78(2): 165-174 (1998); Gaiddon et al., Endocrinology 136(10): 4331-4338 (1995); Hall et al., Nucleic Acids Research 24(6): 1119-1126 (1996); Peterziel et al., Oncogene 18(46): 6322-6329 (1999) and O'Brian, Oncol. Rep. 5(2): 305-309 (1998)). Moreover, both glycosylation and myristoylation are protein modifications also associated with cancer and cancer progression (see e.g. Dennis et al., Biochem. Biophys. Acta 1473(1):21-34 (1999); Raju et al., Exp. Cell Res. 235(1): 145-154 (1997)). Amidation is another protein modification also associated with cancer and cancer progression (see e.g. Treston et al., J. Natl. Cancer Inst. Monogr. (13): 169-175 (1992)).

In another embodiment, proteins of the invention comprise one or more of the immunoreactive epitopes identified in accordance with art-accepted methods, such as the peptides set forth in Tables V-XVIII, XXVI, and XXVII. CTL epitopes can be determined using specific algorithms to identify peptides within an 193P1E1B protein that are capable of optimally binding to specified HLA alleles (e.g., Table IV; Epimatrix™ and Epimer™, Brown University; and BIMAS.) Moreover, processes for identifying peptides that have sufficient binding affinity for HLA molecules and which are correlated with being immunogenic epitopes, are well known in the art, and are carried out without undue experimentation. In addition, processes for identifying peptides that are immunogenic epitopes, are well known in the art, and are carried out without undue experimentation either in vitro or in vivo.

Also known in the art are principles for creating analogs of such epitopes in order to modulate immunogenicity. For example, one begins with an epitope that bears a CTL or HTL motif (see, e.g., the HLA Class I and HLA Class II motifs/ supermotifs of Table IV). The epitope is analoged by substituting out an amino acid at one of the specified positions, and replacing it with another amino acid specified for that position. For example, one can substitute out a deleterious residue in favor of any other residue, such as a preferred residue as defined in Table IV; substitute a less-preferred residue with a preferred residue as defined in Table IV; or substitute an originally-occurring preferred residue with another preferred residue as defined in Table IV. Substitutions can occur at primary anchor positions or at other positions in a peptide; see, e.g., Table IV.

A variety of references reflect the art regarding the identification and generation of epitopes in a protein of interest as well as analogs thereof. See, for example, WO 9733602 to Chesnut et al.; Sette, Immunogenetics 1999 50(3-4): 201-

212; Sette et al., J. Immunol. 2001 166(2): 1389-1397; Sidney et al., Hum. Immunol. 1997 58(1): 12-20; Kondo et al., Immunogenetics 1997 45(4): 249-258; Sidney et al., J. Immunol. 1996 157(8): 3480-90; and Falk et al., Nature 351: 290-6 (1991); Hunt et al., Science 255:1261-3 (1992); Parker et al., J. Immunol. 149:3580-7 (1992); Parker et al., J. Immunol. 152:163-75 (1994)); Kast et al., 1994 152(8): 3904-12; Borras-Cuesta et al., Hum. Immunol. 2000 61(3): 266-278; Alexander et al., J. Immunol. 2000 164(3); 164(3): 1625-1633; Alexander et al., PMID: 7895164, UI: 95202582; O'Sullivan et al., J. Immunol. 1991 147(8): 2663-2669; Alexander et al., Immunity 1994 1(9): 751-761 and Alexander et al., Immunol. Res. 1998 18(2): 79-92.

Related embodiments of the inventions include polypeptides comprising combinations of the different motifs set forth in Table XIX, and/or, one or more of the predicted CTL epitopes of Table V through Table XVIII, and/or, one or more of the T cell binding motifs known in the art. Preferred embodiments contain no insertions, deletions or substitutions either within the motifs or the intervening sequences of the polypeptides. In addition, embodiments which include a number of either N-terminal and/or C-terminal amino acid residues on either side of these motifs may be desirable (to, for example, include a greater portion of the polypeptide architecture in which the motif is located). Typically the number of N-terminal and/or C-terminal amino acid residues on either side of a motif is between about 1 to about 100 amino acid residues, preferably 5 to about 50 amino acid residues.

193P1E1B-related proteins are embodied in many forms, preferably in isolated form. A purified 193P1E1B protein molecule will be substantially free of other proteins or molecules that impair the binding of 193P1E1B to antibody, T cell or other ligand. The nature and degree of isolation and purification will depend on the intended use. Embodiments of a 193P1E1B-related proteins include purified 193P1E1B-related proteins and functional, soluble 193P1E1B-related proteins. In one embodiment, a functional, soluble 193P1E1B protein or fragment thereof retains the ability to be bound by antibody, T cell or other ligand.

The invention also provides 193P1E1B proteins comprising biologically active fragments of a 193P1E1B amino acid sequence shown in FIG. 2 or FIG. 3. Such proteins exhibit properties of the starting 193P1E1B protein, such as the ability to elicit the generation of antibodies that specifically bind an epitope associated with the starting 193P1E1B protein; to be bound by such antibodies; to elicit the activation of HTL or CTL; and/or, to be recognized by HTL or CTL that also specifically bind to the starting protein.

193P1E1B-related polypeptides that contain particularly interesting structures can be predicted and/or identified using various analytical techniques well known in the art, including, for example, the methods of Chou-Fasman, Garnier-Robson, Kyte-Doolittle, Eisenberg, Karplus-Schultz or Jameson-Wolf analysis, or on the basis of immunogenicity. Fragments that contain such structures are particularly useful in generating subunit-specific anti-193P1E1B antibodies, or T cells or in identifying cellular factors that bind to 193P1E1B.

CTL epitopes can be determined using specific algorithms to identify peptides within an 193P1E1B protein that are capable of optimally binding to specified HLA alleles (e.g., by using the SYFPEITHI site at World Wide Web; the listings in Table IV(A)-(E); Epimatrix™ and Epimer™, Brown University; and BIMAS. Illustrating this, peptide epitopes from l93PlEIB that are presented in the context of human MHC class I molecules HLA-A 1, A2, A3, A11, A24, B7 and B35 were predicted (Tables V-XVIII, XXVI, and XXVII). Specifically, the complete amino acid sequence of the 193P1E1B protein and relevant portions of other variants, i.e., for HLA Class I predictions 9 flanking residues on either side of a point mutation, and for HLA Class II predictions 14 flanking residues on either side of a point mutation, were entered into the HLA Peptide Motif Search algorithm found in the Bioinformatics and Molecular Analysis Section (BIMAS) web site listed above; for HLA Class lithe site SYFPEITHI was used.

The HLA peptide motif search algorithm was developed by Dr. Ken Parker based on binding of specific peptide sequences in the groove of HLA Class I molecules, in particular HLA-A2 (see, e.g., Falk et al., Nature 351: 290-6 (1991); Hunt et al., Science 255:1261-3 (1992); Parker et al., J. Immunol. 149:3580-7 (1992); Parker et al., J. Immunol. 152:163-75 (1994)). This algorithm allows location and ranking of 8-mer, 9-mer, and 10-mer peptides from a complete protein sequence for predicted binding to HLA-A2 as well as numerous other HLA Class I molecules. Many HLA class I binding peptides are 8-, 9-, 10 or 11-mers. For example, for class I HLA-A2, the epitopes preferably contain a leucine (L) or methionine (M) at position 2 and a valine (V) or leucine (L) at the C-terminus (see, e.g., Parker et al., J. Immunol. 149: 3580-7 (1992)). Selected results of 193P1E1B predicted binding peptides are shown in Tables V-XVIII, XXVI, and XXVII herein. In Tables V-XVIII, the top 50 ranking candidates, 9-mers and 10-mers, for each family member are shown along with their location, the amino acid sequence of each specific peptide, and an estimated binding score. The binding score corresponds to the estimated half time of dissociation of complexes containing the peptide at 37° C. at pH 6.5. Peptides with the highest binding score are predicted to be the most tightly bound to HLA Class I on the cell surface for the greatest period of time and thus represent the best immunogenic targets for T-cell recognition.

Actual binding of peptides to an HLA allele can be evaluated by stabilization of HLA expression on the antigen-processing defective cell line T2 (see, e.g., Xue et al., Prostate 30:73-8 (1997) and Peshwa et al., Prostate 36:129-38 (1998)). Immunogenicity of specific peptides can be evaluated in vitro by stimulation of CD8+ cytotoxic T lymphocytes (CTL) in the presence of antigen presenting cells such as dendritic cells.

It is to be appreciated that every epitope predicted by the BIMAS site, Epimer™ and Epimatrix™ sites, or specified by the HLA class I or class II motifs available in the art or which become part of the art such as set forth in Table W (or determined using World Wide Web site URL syfpeithi.bmi-heidelberg.com/, or BIMAS, bimas.dcrt.nih.gov/) are to be "applied" to a 193P1E1B protein in accordance with the invention. As used in this context "applied" means that a 193P1E1B protein is evaluated, e.g., visually or by computer-based patterns finding methods, as appreciated by those of skill in the relevant art. Every subsequence of a 193P1E1B protein of 8, 9, 10, or 11 amino acid residues that bears an HLA Class I motif, or a subsequence of 9 or more amino acid residues that bear an HLA Class II motif are within the scope of the invention.

III.B.) Expression of 193P1E1B-Related Proteins

In an embodiment described in the examples that follow, 193P1E1B can be conveniently expressed in cells (such as 293T cells) transfected with a commercially available expression vector such as a CMV-driven expression vector encoding 193P1E1B with a C-terminal 6×His (SEQ ID NO: 2990) and MYC tag (pcDNA3.1/mycHIS, Invitrogen or Tag5, Gen-Hunter Corporation, Nashville Tenn.). The Tag5 vector provides an IgGK secretion signal that can be used to facilitate the production of a secreted 193P1E1B protein in transfected cells. The secreted HIS-tagged 193P1E1B in the culture media can be purified, e.g., using a nickel column using standard techniques.

III.C.) Modifications of 193P1E1B-Related Proteins

Modifications of 193P1E1B-related proteins such as covalent modifications are included within the scope of this invention. One type of covalent modification includes reacting targeted amino acid residues of a 193P1E1B polypeptide with an organic derivatizing agent that is capable of reacting with selected side chains or the N- or C-terminal residues of a 193P1E1B protein. Another type of covalent modification of a 193P1E1B polypeptide included within the scope of this invention comprises altering the native glycosylation pattern of a protein of the invention. Another type of covalent modification of 193P1E1B comprises linking a 193P1E1B polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The 193P1E1B-related proteins of the present invention can also be modified to form a chimeric molecule comprising 193P1E1B fused to another, heterologous polypeptide or amino acid sequence. Such a chimeric molecule can be synthesized chemically or recombinantly. A chimeric molecule can have a protein of the invention fused to another tumor-associated antigen or fragment thereof. Alternatively, a protein in accordance with the invention can comprise a fusion of fragments of a 193P1E1B sequence (amino or nucleic acid) such that a molecule is created that is not, through its length, directly homologous to the amino or nucleic acid sequences shown in FIG. 2 or FIG. 3. Such a chimeric molecule can comprise multiples of the same subsequence of 193P1E1B. A chimeric molecule can comprise a fusion of a 193P1E1B-related protein with a polyhistidine epitope tag, which provides an epitope to which immobilized nickel can selectively bind, with cytokines or with growth factors. The epitope tag is generally placed at the amino- or carboxyl-terminus of a193P1E1B protein. In an alternative embodiment, the chimeric molecule can comprise a fusion of a 193P1E1B-related protein with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a 193P1E1B polypeptide in place of at least one variable region within an Ig molecule. In a preferred embodiment, the immunoglobulin fusion includes the hinge, CH2 and CH3, or the hinge, CH1, CH2 and CH3 regions of an IgGl molecule. For the production of immunoglobulin fusions see, e.g., U.S. Pat. No. 5,428,130 issued Jun. 27, 1995.

III.D.) Uses of 193P1E1B-Related Proteins

The proteins of the invention have a number of different specific uses. As 193P1E1B is highly expressed in prostate and other cancers, 193P1E1B-related proteins are used in methods that assess the status of 193P1E1B gene products in normal versus cancerous tissues, thereby elucidating the malignant phenotype. Typically, polypeptides from specific regions of a 193P1E1B protein are used to assess the presence of perturbations (such as deletions, insertions, point mutations etc.) in those regions (such as regions containing one or more motifs). Exemplary assays utilize antibodies or T cells targeting 193P1E1B-related proteins comprising the amino acid residues of one or more of the biological motifs contained within a 193P1E1B polypeptide sequence in order to evaluate the characteristics of this region in normal versus cancerous tissues or to elicit an immune response to the epitope. Alternatively, 193P1E1B-related proteins that contain the amino acid residues of one or more of the biological motifs in a 193P1E1B protein are used to screen for factors that interact with that region of 193P1E1B.

193P1E1B protein fragments/subsequences are particularly useful in generating and characterizing domain-specific antibodies (e.g., antibodies recognizing an extracellular or intracellular epitope of an 193P1E1B protein), for identifying agents or cellular factors that bind to 193P1E1B or a particular structural domain thereof, and in various therapeutic and diagnostic contexts, including but not limited to diagnostic assays, cancer vaccines and methods of preparing such vaccines.

Proteins encoded by the 193P1E1B genes, or by analogs, homologs or fragments thereof, have a variety of uses, including but not limited to generating antibodies and in methods for identifying ligands and other agents and cellular constituents that bind to an 193P1E1B gene product. Antibodies raised against an 193P1E1B protein or fragment thereof are useful in diagnostic and prognostic assays, and imaging methodologies in the management of human cancers characterized by expression of 193P1E1B protein, such as those listed in Table I. Such antibodies can be expressed intracellularly and used in methods of treating patients with such cancers. 193P1E1B-related nucleic acids or proteins are also used in generating HTL or CTL responses.

Various immunological assays useful for the detection of 193P1E1B proteins are used, including but not limited to various types of radioimmunoassays, enzyme-linked immunosorbent assays (ELISA), enzyme-linked immunofluorescent assays (ELIFA), immunocytochemical methods, and the like. Antibodies can be labeled and used as immunological imaging reagents capable of detecting 193P1E1B-expressing cells (e.g., in radioscintigraphic imaging methods). 193P1E1B proteins are also particularly useful in generating cancer vaccines, as further described herein.

IV.) 193P1E1B Antibodies

Another aspect of the invention provides antibodies that bind to 193P1E1B-related proteins. Preferred antibodies specifically bind to a 193P1E1B-related protein and do not bind (or bind weakly) to peptides or proteins that are not 193P1E1B-related proteins. For example, antibodies that bind 193P1E1B can bind 193P1E1B-related proteins such as the homologs or analogs thereof.

193P1E1B antibodies of the invention are particularly useful in cancer (see, e.g., Table I) diagnostic and prognostic assays, and imaging methodologies. Similarly, such antibodies are useful in the treatment, diagnosis, and/or prognosis of other cancers, to the extent 193P1E1B is also expressed or overexpressed in these other cancers. Moreover, intracellularly expressed antibodies (e.g., single chain antibodies) are therapeutically useful in treating cancers in which the expression of 193P1E1B is involved, such as advanced or metastatic prostate cancers.

The invention also provides various immunological assays useful for the detection and quantification of 193P1E1B and mutant 193P1E1B-related proteins. Such assays can comprise one or more 193P1E1B antibodies capable of recognizing and binding a 193P1E1B-related protein, as appropriate. These assays are performed within various immunological assay formats well known in the art, including but not limited to various types of radioimmunoassays, enzyme-linked immunosorbent assays (ELISA), enzyme-linked immunofluorescent assays (ELIFA), and the like.

Immunological non-antibody assays of the invention also comprise T cell immunogenicity assays (inhibitory or stimulatory) as well as major histocompatibility complex (MHC) binding assays.

In addition, immunological imaging methods capable of detecting prostate cancer and other cancers expressing 193P1E1B are also provided by the invention, including but not limited to radioscintigraphic imaging methods using labeled 193P1E1B antibodies. Such assays are clinically useful in the detection, monitoring, and prognosis of 193P1E1B expressing cancers such as prostate cancer.

193P1E1B antibodies are also used in methods for purifying a 193P1E1B-related protein and for isolating 193P1E1B homologues and related molecules. For example, a method of purifying a 193P1E1B-related protein comprises incubating an 193P1E1B antibody, which has been coupled to a solid matrix, with a lysate or other solution containing a 193P1E1B-related protein under conditions that permit the 193P1E1B antibody to bind to the 193P1E1B-related protein; washing the solid matrix to eliminate impurities; and eluting the 193P1E1B-related protein from the coupled antibody. Other uses of 193P1E1B antibodies in accordance with the invention include generating anti-idiotypic antibodies that mimic a 193P1E1B protein.

Various methods for the preparation of antibodies are well known in the art. For example, antibodies can be prepared by immunizing a suitable mammalian host using a 193P1E1B-related protein, peptide, or fragment, in isolated or immunoconjugated form (Antibodies: A Laboratory Manual, CSH Press, Eds., Harlow, and Lane (1988); Harlow, Antibodies, Cold Spring Harbor Press, NY (1989)). In addition, fusion proteins of 193P1E1B can also be used, such as a 193P1E1B GST-fusion protein. In a particular embodiment, a GST fusion protein comprising all or most of the amino acid sequence of FIG. 2 or FIG. 3 is produced, then used as an immunogen to generate appropriate antibodies. In another embodiment, a 193P1E1B-related protein is synthesized and used as an immunogen.

In addition, naked DNA immunization techniques known in the art are used (with or without purified 193P1E1B-related protein or 193P1E1B expressing cells) to generate an immune response to the encoded immunogen (for review, see Donnelly et al., 1997, Ann. Rev. Immunol. 15: 617-648).

The amino acid sequence of a 193P1E1B protein as shown in FIG. 2 or FIG. 3 can be analyzed to select specific regions of the 193P1E1B protein for generating antibodies. For example, hydrophobicity and hydrophilicity analyses of a 193P1E1B amino acid sequence are used to identify hydrophilic regions in the 193P1E1B structure. Regions of a 193P1E1B protein that show immunogenic structure, as well as other regions and domains, can readily be identified using various other methods known in the art, such as Chou-Fasman, Garnier-Robson, Kyte-Doolittle, Eisenberg, Karplus-Schultz, Hopp-Woods, Janin, Bhaskaran-Ponnuswamy, Hierarchical Neural Network, Deleage-Roux, and Jameson-Wolf analysis. Thus, each region identified by any of these programs or methods is within the scope of the present invention. Methods for the generation of 193P1E1B antibodies are further illustrated by way of the examples provided herein. Methods for preparing a protein or polypeptide for use as an immunogen are well known in the art. Also well known in the art are methods for preparing immunogenic conjugates of a protein with a carrier, such as BSA, KLH or other carrier protein. In some circumstances, direct conjugation using, for example, carbodiimide reagents are used; in other instances linking reagents such as those supplied by Pierce Chemical Co., Rockford, Ill., are effective. Administration of a 193P1E1B immunogen is often conducted by injection over a suitable time period and with use of a suitable adjuvant, as is understood in the art. During the immunization schedule, titers of antibodies can be taken to determine adequacy of antibody formation.

193P1E1B monoclonal antibodies can be produced by various means well known in the art. For example, immortalized cell lines that secrete a desired monoclonal antibody are prepared using the standard hybridoma technology of Kohler and Milstein or modifications that immortalize antibody-producing B cells, as is generally known. Immortalized cell lines that secrete the desired antibodies are screened by immunoassay in which the antigen is a 193P1E1B-related protein. When the appropriate immortalized cell culture is identified, the cells can be expanded and antibodies produced either from in vitro cultures or from ascites fluid.

The antibodies or fragments of the invention can also be produced, by recombinant means. Regions that bind specifically to the desired regions of a 193P1E1B protein can also be produced in the context of chimeric or complementarity determining region (CDR) grafted antibodies of multiple species origin. Humanized or human 193P1E1B antibodies can also be produced, and are preferred for use in therapeutic contexts. Methods for humanizing murine and other non-human antibodies, by substituting one or more of the non-human antibody CDRs for corresponding human antibody sequences, are well known (see for example, Jones et al., 1986, Nature 321: 522-525; Riechmann et al., 1988, Nature 332: 323-327; Verhoeyen et al., 1988, Science 239: 1534-1536). See also, Carter et al., 1993, Proc. Natl. Acad. Sci. USA 89: 4285 and Sims et al., 1993, J. Immunol. 151: 2296.

Methods for producing fully human monoclonal antibodies include phage display and transgenic methods (for review, see Vaughan et al., 1998, Nature Biotechnology 16: 535-539). Fully human 193P1E1B monoclonal antibodies can be generated using cloning technologies employing large human Ig gene combinatorial libraries (i.e., phage display) (Griffiths and Hoogenboom, Building an in vitro immune system: human antibodies from phage display libraries. In: Protein Engineering of Antibody Molecules for Prophylactic and Therapeutic Applications in Man, Clark, M. (Ed.), Nottingham Academic, pp 45-64 (1993); Burton and Barbas, Human Antibodies from combinatorial libraries. Id., pp 65-82). Fully human 193P1E1B monoclonal antibodies can also be produced using transgenic mice engineered to contain human immunoglobulin gene loci as described in PCT Patent Application WO98/24893, Kucherlapati and Jakobovits et al., published Dec. 3, 1997 (see also, Jakobovits, 1998, Exp. Opin. Invest. Drugs 7(4): 607-614; U.S. Pat. No. 6,162,963 issued 19 Dec. 2000; U.S. Pat. No. 6,150,584 issued 12 Nov. 2000; and, U.S. Pat. No. 6,114,598 issued 5 Sep. 2000). This method avoids the in vitro manipulation required with phage display technology and efficiently produces high affinity authentic human antibodies.

Reactivity of 193P1E1B antibodies with an 193P1E1B-related protein can be established by a number of well known means, including Western blot, immunoprecipitation, ELISA, and FACS analyses using, as appropriate, 193P1E1B-related proteins, 193P1E1B-expressing cells or extracts thereof. A 193P1E1B antibody or fragment thereof can be labeled with a detectable marker or conjugated to a second molecule. Suitable detectable markers include, but are not limited to, a radioisotope, a fluorescent compound, a bioluminescent compound, chemiluminescent compound, a metal chelator or an enzyme. Further, bi-specific antibodies specific for two or more 193P1E1B epitopes are generated using methods generally known in the art. Homodimeric antibodies can also be generated by cross-linking techniques known in the art (e.g., Wolff et al., Cancer Res. 53: 2560-2565).

V.) 193P1E1B Cellular Immune Responses

The mechanism by which T cells recognize antigens has been delineated. Efficacious peptide epitope vaccine compositions of the invention induce a therapeutic or prophylactic immune responses in very broad segments of the world-wide population. For an understanding of the value and efficacy of compositions of the invention that induce cellular immune responses, a brief review of immunology-related technology is provided.

A complex of an HLA molecule and a peptidic antigen acts as the ligand recognized by HLA-restricted T cells (Buus, S. et al., Cell 47:1071, 1986; Babbitt, B. P. et al., Nature 317: 359, 1985; Townsend, A. and Bodmer, H., Annu. Rev. Immunol. 7:601, 1989; Germain, R. N., Annu. Rev. Immunol. 11:403, 1993). Through the study of single amino acid substituted antigen analogs and the sequencing of endogenously bound, naturally processed peptides, critical residues that correspond to motifs required for specific binding to HLA antigen molecules have been identified and are set forth in Table IV (see also, e.g., Southwood, et al., J. Immunol. 160: 3363, 1998; Rammensee, et al., Immunogenetics 41:178, 1995; Rammensee et al., SYFPEITHI, access via World Wide Web at URL syfpeithi.bmi-heidelberg.com/; Sette, A. and Sidney, J. Curr. Opin. Immunol. 10:478, 1998; Engelhard, V. H., Curr. Opin. Immunol. 6:13, 1994; Sette, A. and Grey, H. M., Curr. Opin. Immunol. 4:79, 1992; Sinigaglia, F. and Hammer, J. Curr. Biol. 6:52, 1994; Ruppert et al., Cell 74:929-937, 1993; Kondo et al., J. Immunol. 155:4307-4312, 1995; Sidney et al., J. Immunol. 157:3480-3490, 1996; Sidney et al., Human Immunol. 45:79-93, 1996; Sette, A. and Sidney, J. Immunogenetics 1999 November; 50(3-4):201-12, Review).

Furthermore, x-ray crystallographic analyses of HLA-peptide complexes have revealed pockets within the peptide binding cleft/groove of HLA molecules which accommodate, in an allele-specific mode, residues borne by peptide ligands; these residues in turn determine the HLA binding capacity of the peptides in which they are present. (See, e.g., Madden, D. R. Annu. Rev. Immunol. 13:587, 1995; Smith, et al., Immunity 4:203, 1996; Fremont et al., Immunity 8:305, 1998; Stern et al., Structure 2:245, 1994; Jones, E. Y. Curr. Opin. Immunol. 9:75, 1997; Brown, J. H. et al., Nature 364:33, 1993; Guo, H. C. et al., Proc. Natl. Acad. Sci. USA 90:8053, 1993; Guo, H. C. et al., Nature 360:364, 1992; Silver, M. L. et al.; Nature 360:367, 1992; Matsumura, M. et al., Science 257:927, 1992; Madden et al., Cell 70:1035, 1992; Fremont, D. H. et al., Science 257:919, 1992; Saper, M. A., Bjorkman, P. J. and Wiley, D.C., J. Mol. Biol. 219:277, 1991.)

Accordingly, the definition of class I and class II allele-specific HLA binding motifs, or class I or class II supermotifs allows identification of regions within a protein that are correlated with binding to particular HLA antigen(s).

Thus, by a process of HLA motif identification, candidates for epitope-based vaccines have been identified; such candidates can be further evaluated by HLA-peptide binding assays to determine binding affinity and/or the time period of association of the epitope and its corresponding HLA molecule. Additional confirmatory work can be performed to select, amongst these vaccine candidates, epitopes with preferred characteristics in terms of population coverage, and/or immunogenicity.

Various strategies can be utilized to evaluate cellular immunogenicity, including:

1) Evaluation of primary T cell cultures from normal individuals (see, e.g., Wentworth, P. A. et al., Mol. Immunol. 32:603, 1995; Celis, E. et al., Proc. Natl. Acad. Sci. USA 91:2105, 1994; Tsai, V. et al., J. Immunol. 158:1796, 1997; Kawashima, I. et al., Human Immunol. 59:1, 1998). This procedure involves the stimulation of peripheral blood lymphocytes (PBL) from normal subjects with a test peptide in the presence of antigen presenting cells in vitro over a period of several weeks. T cells specific for the peptide become activated during this time and are detected using, e.g., a lymphokine- or $^{51}$Cr-release assay involving peptide sensitized target cells.

2) Immunization of HLA transgenic mice (see, e.g., Wentworth, P. A. et al., J. Immunol. 26:97, 1996; Wentworth, P. A. et al., Int. Immunol. 8:651, 1996; Alexander, J. et al., J. Immunol. 159:4753, 1997). For example, in such methods peptides in incomplete Freund's adjuvant are administered subcutaneously to HLA transgenic mice. Several weeks following immunization, splenocytes are removed and cultured in vitro in the presence of test peptide for approximately one week. Peptide-specific T cells are detected using, e.g., a $^{51}$Cr-release assay involving peptide sensitized target cells and target cells expressing endogenously generated antigen.

3) Demonstration of recall T cell responses from immune individuals who have been either effectively vaccinated and/or from chronically ill patients (see, e.g., Rehermann, B. et al., J. Exp. Med. 181:1047, 1995; Doolan, D. L. et al., Immunity 7:97, 1997; Bertoni, R. et al., J. Clin. Invest. 100:503, 1997; Threlkeld, S. C. et al., J. Immunol. 159:1648, 1997; Diepolder, H. M. et al., J. Virol. 71:6011, 1997). Accordingly, recall responses are detected by culturing PBL from subjects that have been exposed to the antigen due to disease and thus have generated an immune response "naturally", or from patients who were vaccinated against the antigen. PBL from subjects are cultured in vitro for 1-2 weeks in the presence of test peptide plus antigen presenting cells (APC) to allow activation of "memory" T cells, as compared to "naive" T cells. At the end of the culture period, T cell activity is detected using assays including $^{51}$Cr release involving peptide-sensitized targets, T cell proliferation, or lymphokine release.

VI.) 193P1E1B Transgenic Animals

Nucleic acids that encode a 193P1E1B-related protein can also be used to generate either transgenic animals or "knock out" animals that, in turn, are useful in the development and screening of therapeutically useful reagents. In accordance with established techniques, cDNA encoding 193P1E1B can be used to clone genomic DNA that encodes 193P1E1B. The cloned genomic sequences can then be used to generate transgenic animals containing cells that express DNA that encode 193P1E1B. Methods for generating transgenic animals, particularly animals such as mice or rats, have become conventional in the art and are described, for example, in U.S. Pat. No. 4,736,866 issued 12 Apr. 1988, and U.S. Pat. No. 4,870,009 issued 26 Sep. 1989. Typically, particular cells would be targeted for 193P1E1B transgene incorporation with tissue-specific enhancers.

Transgenic animals that include a copy of a transgene encoding 193P1E1B can be used to examine the effect of increased expression of DNA that encodes 193P1E1B. Such animals can be used as tester animals for reagents thought to confer protection from, for example, pathological conditions associated with its overexpression. In accordance with this aspect of the invention, an animal is treated with a reagent and a reduced incidence of a pathological condition, compared to untreated animals that bear the transgene, would indicate a potential therapeutic intervention for the pathological condition.

Alternatively, non-human homologues of 193P1E1B can be used to construct a 193P1E1B "knock out" animal that has a defective or altered gene encoding 193P1E1B as a result of homologous recombination between the endogenous gene encoding 193P1E1B and altered genomic DNA encoding 193P1E1B introduced into an embryonic cell of the animal. For example, cDNA that encodes 193P1E1B can be used to clone genomic DNA encoding 193P1E1B in accordance with established techniques. A portion of the genomic DNA encoding 193P1E1B can be deleted or replaced with another gene, such as a gene encoding a selectable marker that can be used to monitor integration. Typically, several kilobases of unaltered flanking DNA (both at the 5' and 3' ends) are included in the vector (see, e.g., Thomas and Capecchi, *Cell,* 51:503 (1987) for a description of homologous recombination vectors). The vector is introduced into an embryonic stem cell line (e.g., by electroporation) and cells in which the introduced DNA has homologously recombined with the endogenous DNA are selected (see, e.g., Li et al., *Cell,* 69:915 (1992)). The selected cells are then injected into a blastocyst of an animal (e.g., a mouse or rat) to form aggregation chimeras (see, e.g., Bradley, in *Teratocarcinomas and Embryonic Stem Cells: A Practical Approach,* E. J. Robertson, ed. (IRL, Oxford, 1987), pp. 113-152). A chimeric embryo can then be implanted into a suitable pseudopregnant female foster animal, and the embryo brought to term to create a "knock out" animal. Progeny harboring the homologously recombined DNA in their germ cells can be identified by standard techniques and used to breed animals in which all cells of the animal contain the homologously recombined DNA. Knock out animals can be characterized, for example, for their ability to defend against certain pathological conditions or for their development of pathological conditions due to absence of a 193P1E1B polypeptide.

VII.) Methods for the Detection of 193P1E1B

Another aspect of the present invention relates to methods for detecting 193P1E1B polynucleotides and 193P1E1B-related proteins, as well as methods for identifying a cell that expresses 193P1E1B. The expression profile of 193P1E1B makes it a diagnostic marker for metastasized disease. Accordingly, the status of 193P1E1B gene products provides information useful for predicting a variety of factors including susceptibility to advanced stage disease, rate of progression, and/or tumor aggressiveness. As discussed in detail herein, the status of 193P1E1B gene products in patient samples can be analyzed by a variety protocols that are well known in the art including immunohistochemical analysis, the variety of Northern blotting techniques including in situ hybridization, RT-PCR analysis (for example on laser capture micro-dissected samples), Western blot analysis and tissue array analysis.

More particularly, the invention provides assays for the detection of 193P1E1B polynucleotides in a biological sample, such as serum, bone, prostate, and other tissues, urine, semen, cell preparations, and the like. Detectable 193P1E1B polynucleotides include, for example, a 193P1E1B gene or fragment thereof, 193P1E1B mRNA, alternative splice variant 193P1E1B mRNAs, and recombinant DNA or RNA molecules that contain a 193P1E1B polynucleotide. A number of methods for amplifying and/or detecting the presence of 193P1E1B polynucleotides are well known in the art and can be employed in the practice of this aspect of the invention.

In one embodiment, a method for detecting an 193P1E1B mRNA in a biological sample comprises producing cDNA from the sample by reverse transcription using at least one primer; amplifying the cDNA so produced using an 193P1E1B polynucleotides as sense and antisense primers to amplify 193P1E1B cDNAs therein; and detecting the presence of the amplified 193P1E1B cDNA. Optionally, the sequence of the amplified 193P1E1B cDNA can be determined.

In another embodiment, a method of detecting a 193P1E1B gene in a biological sample comprises first isolating genomic DNA from the sample; amplifying the isolated genomic DNA using 193P1E1B polynucleotides as sense and antisense primers; and detecting the presence of the amplified 193P1E1B gene. Any number of appropriate sense and antisense probe combinations can be designed from a 192P1E1B nucleotide sequence (see, e.g., FIG. 2) and used for this purpose.

The invention also provides assays for detecting the presence of an 193P1E1B protein in a tissue or other biological sample such as serum, semen, bone, prostate, urine, cell preparations, and the like. Methods for detecting a 193P1E1B-related protein are also well known and include, for example, immunoprecipitation, immunohistochemical analysis, Western blot analysis, molecular binding assays, ELISA, ELIFA and the like. For example, a method of detecting the presence of a 193P1E1B-related protein in a biological sample comprises first contacting the sample with a 193P1E1B antibody, a 193P1E1B-reactive fragment thereof, or a recombinant protein containing an antigen binding region of a 193P1E1B antibody; and then detecting the binding of 193P1E1B-related protein in the sample.

Methods for identifying a cell that expresses 193P1E1B are also within the scope of the invention. In one embodiment, an assay for identifying a cell that expresses a 193P1E1B gene comprises detecting the presence of 193P1E1B mRNA in the cell. Methods for the detection of particular mRNAs in cells are well known and include, for example, hybridization assays using complementary DNA probes (such as in situ hybridization using labeled 193P1E1B riboprobes, Northern blot and related techniques) and various nucleic acid amplification assays (such as RT-PCR using complementary primers specific for 193P1E1B, and other amplification type detection methods, such as, for example, branched DNA, SISBA, TMA and the like). Alternatively, an assay for identifying a cell that expresses a 193P1E1B gene comprises detecting the presence of 193P1E1B-related protein in the cell or secreted by the cell. Various methods for the detection of proteins are well known in the art and are employed for the detection of 193P1E1B-related proteins and cells that express 193P1E1B-related proteins.

193P1E1B expression analysis is also useful as a tool for identifying and evaluating agents that modulate 193P1E1B gene expression. For example, 193P1E1B expression is significantly upregulated in prostate cancer, and is expressed in cancers of the tissues listed in Table I. Identification of a molecule or biological agent that inhibits 193P1E1B expression or over-expression in cancer cells is of therapeutic value. For example, such an agent can be identified by using a screen that quantifies 193P1E1B expression by RT-PCR, nucleic acid hybridization or antibody binding.

VIII.) Methods for Monitoring the Status of 193P1E1B-Related Genes and Their Products Oncogenesis is known to be a multistep process where cellular growth becomes progressively dysregulated and cells progress from a normal physiological state to precancerous and then cancerous states (see, e.g., Alers et al., Lab Invest. 77(5): 437-438 (1997) and Isaacs et al., Cancer Surv. 23:19-32 (1995)). In this context, examining a biological sample for evidence of dysregulated cell growth (such as aberrant 193P1E1B expression in cancers) allows for early detection of such aberrant physiology, before a pathologic state such as cancer has progressed to a stage that therapeutic options are more limited and or the prognosis is worse. In such examinations, the status of 193P1E1B in a biological sample of interest can be compared, for example, to the status of 193P1E1B in a corresponding normal sample (e.g. a sample from that individual or alternatively another individual that is not affected by a pathology). An alteration in the status of 193P1E1B in the biological sample (as compared to the normal sample) provides evidence of dysregulated cellular growth. In addition to using a biological sample that is not affected by a pathology as a normal sample, one can also use a predetermined normative value such as a predetermined normal level of mRNA expression (see, e.g., Grever et al., J. Comp. Neurol. 1996 Dec. 9; 376(2): 306-14 and U.S. Pat. No. 5,837,501) to compare 193P1E1B status in a sample.

The term "status" in this context is used according to its art accepted meaning and refers to the condition or state of a gene and its products. Typically, skilled artisans use a number of parameters to evaluate the condition or state of a gene and its products. These include, but are not limited to the location of expressed gene products (including the location of 193P1E1B expressing cells) as well as the level, and biological activity of expressed gene products (such as 193P1E1B mRNA, polynucleotides and polypeptides). Typically, an alteration in the status of 193P1E1B comprises a change in the location of 193P1E1B and/or 193P1E1B expressing cells and/or an increase in 193P1E1B mRNA and/or protein expression.

193P1E1B status in a sample can be analyzed by a number of means well known in the art, including without limitation, immunohistochemical analysis, in situ hybridization, RT-PCR analysis on laser capture micro-dissected samples, Western blot analysis, and tissue array analysis. Typical protocols for evaluating the status of a 193P1E1B gene and gene products are found, for example in Ausubel et al. eds., 1995, Current Protocols In Molecular Biology, Units 2 (Northern Blotting), 4 (Southern Blotting), 15 (Immunoblotting) and 18 (PCR Analysis). Thus, the status of 193P1E1B in a biological sample is evaluated by various methods utilized by skilled artisans including, but not limited to genomic Southern analysis (to examine, for example perturbations in a 193P1E1B gene), Northern analysis and/or PCR analysis of 193P1E1B mRNA (to examine, for example alterations in the polynucleotide sequences or expression levels of 193P1E1B mRNAs), and, Western and/or immunohistochemical analysis (to examine, for example alterations in polypeptide sequences, alterations in polypeptide localization within a sample, alterations in expression levels of 193P1E1B proteins and/or associations of 193P1E1B proteins with polypeptide binding partners). Detectable 193P1E1B polynucleotides include, for example, a 193P1E1B gene or fragment thereof, 193P1E1B mRNA, alternative splice variants, 193P1E1B mRNAs, and recombinant DNA or RNA molecules containing a 193P1E1B polynucleotide.

The expression profile of 193P1E1B makes it a diagnostic marker for local and/or metastasized disease, and provides information on the growth or oncogenic potential of a biological sample. In particular, the status of 193P1E1B provides information useful for predicting susceptibility to particular disease stages, progression, and/or tumor aggressiveness. The invention provides methods and assays for determining 193P1E1B status and diagnosing cancers that express 193P1E1B, such as cancers of the tissues listed in Table I. For example, because 193P1E1B mRNA is so highly expressed in prostate and other cancers relative to normal prostate tissue, assays that evaluate the levels of 193P1E1B mRNA transcripts or proteins in a biological sample can be used to diagnose a disease associated with 193P1E1B dysregulation, and can provide prognostic information useful in defining appropriate therapeutic options.

The expression status of 193P1E1B provides information including the presence, stage and location of dysplastic, precancerous and cancerous cells, predicting susceptibility to various stages of disease, and/or for gauging tumor aggressiveness. Moreover, the expression profile makes it useful as an imaging reagent for metastasized disease. Consequently, an aspect of the invention is directed to the various molecular prognostic and diagnostic methods for examining the status of 193P1E1B in biological samples such as those from individuals suffering from, or suspected of suffering from a pathology characterized by dysregulated cellular growth, such as cancer.

As described above, the status of 193P1E1B in a biological sample can be examined by a number of well-known procedures in the art. For example, the status of 193P1E1B in a biological sample taken from a specific location in the body can be examined by evaluating the sample for the presence or absence of 193P1E1B expressing cells (e.g. those that express 193P1E1B mRNAs or proteins). This examination can provide evidence of dysregulated cellular growth, for example, when 193P1E1B-expressing cells are found in a biological sample that does not normally contain such cells (such as a lymph node), because such alterations in the status of 193P1E1B in a biological sample are often associated with dysregulated cellular growth. Specifically, one indicator of dysregulated cellular growth is the metastases of cancer cells from an organ of origin (such as the prostate) to a different area of the body (such as a lymph node). In this context, evidence of dysregulated cellular growth is important for example because occult lymph node metastases can be detected in a substantial proportion of patients with prostate cancer, and such metastases are associated with known predictors of disease progression (see, e.g., Murphy et al., Prostate 42(4): 315-317 (2000);Su et al., Semin. Surg. Oncol. 18(1): 17-28 (2000) and Freeman et al., J Urol 1995 August 154(2 Pt 1):474-8).

In one aspect, the invention provides methods for monitoring 193P1E1B gene products by determining the status of 193P1E1B gene products expressed by cells from an individual suspected of having a disease associated with dysregulated cell growth (such as hyperplasia or cancer) and then comparing the status so determined to the status of 193P1E1B gene products in a corresponding normal sample. The presence of aberrant 193P1E1B gene products in the test sample relative to the normal sample provides an indication of the presence of dysregulated cell growth within the cells of the individual.

In another aspect, the invention provides assays useful in determining the presence of cancer in an individual, comprising detecting a significant increase in 193P1E1B mRNA or protein expression in a test cell or tissue sample relative to expression levels in the corresponding normal cell or tissue. The presence of 193P1E1B mRNA can, for example, be evaluated in tissue samples including but not limited to those listed in Table 1. The presence of significant 0.193P1E1B expression in any of these tissues is useful to indicate the emergence, presence and/or severity of a cancer, since the corresponding normal tissues do not express 193P1E1B mRNA or express it at lower levels.

In a related embodiment, 193P1E1B status is determined at the protein level rather than at the nucleic acid level. For example, such a method comprises determining the level of 193P1E1B protein expressed by cells in a test tissue sample and comparing the level so determined to the level of 193P1E1B expressed in a corresponding normal sample. In one embodiment, the presence of 193P1E1B protein is evaluated, for example, using immunohistochemical methods. 193P1E1B antibodies or binding partners capable of detecting 193P1E1B protein expression are used in a variety of assay formats well known in the art for this purpose.

In a further embodiment, one can evaluate the status of 193P1E1B nucleotide and amino acid sequences in a biological sample in order to identify perturbations in the structure of these molecules. These perturbations can include insertions, deletions, substitutions and the like. Such evaluations are useful because perturbations in the nucleotide and amino acid sequences are observed in a large number of proteins associated with a growth dysregulated phenotype (see, e.g., Marrogi et al., 1999, J. Cutan. Pathol. 26(8):369-378). For example, a mutation in the sequence of 193P1E1B may be indicative of the presence or promotion of a tumor. Such assays therefore have diagnostic and predictive value where a mutation in 193P1E1B indicates a potential loss of function or increase in tumor growth.

A wide variety of assays for observing perturbations in nucleotide and amino acid sequences are well known in the art. For example, the size and structure of nucleic acid or amino acid sequences of 193P1E1B gene products are observed by the Northern, Southern, Western, PCR and DNA sequencing protocols discussed herein. In addition, other methods for observing perturbations in nucleotide and amino acid sequences such as single strand conformation polymorphism analysis are well known in the art (see, e.g., U.S. Pat. No. 5,382,510 issued 7 Sep. 1999, and U.S. Pat. No. 5,952, 170 issued 17 Jan. 1995).

Additionally, one can examine the methylation status of a 193P1E1B gene in a biological sample. Aberrant demethylation and/or hypermethylation of CpG islands in gene 5' regulatory regions frequently occurs in immortalized and transformed cells, and can result in altered expression of various genes. For example, promoter hypermethylation of the pi-class glutathione S-transferase (a protein expressed in normal prostate but not expressed in >90% of prostate carcinomas) appears to permanently silence transcription of this gene and is the most frequently detected genomic alteration in prostate carcinomas (De Marzo et al., Am. J. Pathol. 155(6): 1985-1992 (1999)). In addition, this alteration is present in at least 70% of cases of high-grade prostatic intraepithelial neoplasia (PIN) (Brooks et al., Cancer Epidemiol. Biomarkers Prev., 1998, 7:531-536). In another example, expression of the LAGE-I tumor specific gene (which is-not expressed in normal prostate but is expressed in 25-50% of prostate cancers) is induced by deoxy-azacytidine in lymphoblastoid cells, suggesting that tumoral expression is due to demethylation (Lethe et al., Int. J. Cancer 76(6): 903-908 (1998)). A variety of assays for examining methylation status of a gene are well known in the art. For example, one can utilize, in Southern hybridization approaches, methylation-sensitive restriction enzymes that cannot cleave sequences that contain methylated CpG sites to assess the methylation status of CpG islands. In addition, MSP (methylation specific PCR) can rapidly profile the methylation status of all the CpG sites present in a CpG island of a given gene. This procedure involves initial modification of DNA by sodium bisulfite (which will convert all unmethylated cytosines to uracil) followed by amplification using primers specific for methylated versus unmethylated DNA. Protocols involving methylation interference can also be found for example in Current Protocols In Molecular Biology, Unit 12, Frederick M. Ausubel et al. eds., 1995.

Gene amplification is an additional method for assessing the status of 193P1E1B. Gene amplification is measured in a sample directly, for example, by conventional Southern blotting or Northern blotting to quantitate the transcription of mRNA (Thomas, 1980, Proc. Natl. Acad. Sci. USA, 77:5201-5205), dot blotting (DNA analysis), or in situ hybridization, using an appropriately labeled probe, based on the sequences provided herein. Alternatively, antibodies are employed that recognize specific duplexes, including DNA duplexes, RNA duplexes, and DNA-RNA hybrid duplexes or DNA-protein duplexes. The antibodies in turn are labeled and the assay carried out where the duplex is bound to a surface, so that upon the formation of duplex on the surface, the presence of antibody bound to the duplex can be detected.

Biopsied tissue or peripheral blood can be conveniently assayed for the presence of cancer cells using for example, Northern, dot blot or RT-PCR analysis to detect 193P1E1B expression. The presence of RT-PCR amplifiable 193P1E1B mRNA provides an indication of the presence of cancer. RT-PCR assays are well known in the art. RT-PCR detection assays for tumor cells in peripheral blood are currently being evaluated for use in the diagnosis and management of a number of human solid tumors. In the prostate cancer field, these include RT-PCR assays for the detection of cells expressing PSA and PSM (Verkaik et al., 1997, Urol. Res. 25:373-384; Ghossein et al., 1995, J. Clin. Oncol. 13:1195-2000; Heston et al., 1995, Clin. Chem. 41:1687-1688).

A further aspect of the invention is an assessment of the susceptibility that an individual has for developing cancer. In one embodiment, a method for predicting susceptibility to cancer comprises detecting 193P1E1B mRNA or 193P1E1B protein in a tissue sample, its presence indicating susceptibility to cancer, wherein the degree of 193P1E1B mRNA expression correlates to the degree of susceptibility. In a specific embodiment, the presence of 193P1E1B in prostate or other tissue is examined, with the presence of 193P1E1B in the sample providing an indication of prostate cancer susceptibility (or the emergence or existence of a prostate tumor). Similarly, one can evaluate the integrity 193P1E1B nucleotide and amino acid sequences in a biological sample, in order to identify perturbations in the structure of these molecules such as insertions, deletions, substitutions and the like. The presence of one or more perturbations in 193P1E1B gene products in the sample is an indication of cancer susceptibility (or the emergence or existence of a tumor).

The invention also comprises methods for gauging tumor aggressiveness. In one embodiment, a method for gauging aggressiveness of a tumor comprises determining the level of 193P1E1B mRNA or 193P1E1B protein expressed by tumor cells, comparing the level so determined to the level of 193P1E1B mRNA or 193P1E1B protein expressed in a corresponding normal tissue taken from the same individual or a normal tissue reference sample, wherein the degree of 193P1E1B mRNA or 193P1E1B protein expression in the tumor sample relative to the normal sample indicates the degree of aggressiveness. In a specific embodiment, aggressiveness of a tumor is evaluated by determining the extent to which 193P1E1B is expressed in the tumor cells, with higher expression levels indicating more aggressive tumors. Another embodiment is the evaluation of the integrity of 193P1E1B nucleotide and amino acid sequences in a biological sample, in order to identify perturbations in the structure of these molecules such as insertions, deletions, substitutions and the like. The presence of one or more perturbations indicates more aggressive tumors.

Another embodiment of the invention is directed to methods for observing the progression of a malignancy in an individual over time. In one embodiment, methods for observing the progression of a malignancy in an individual over time comprise determining the level of 193P1E1B mRNA or 193P1E1B protein expressed by cells in a sample of the tumor, comparing the level so determined to the level of 193P1E1B mRNA or 193P1E1B protein expressed in an equivalent tissue sample taken from the same individual at a different time, wherein the degree of 193P1E1B mRNA or 193P1E1B protein expression in the tumor sample over time provides information on the progression of the cancer. In a specific embodiment, the progression of a cancer is evaluated by determining 193P1E1B expression in the tumor cells over time, where increased expression over time indicates a progression of the cancer. Also, one can evaluate the integrity 193P1E1B nucleotide and amino acid sequences in a biological sample in order to identify perturbations in the structure of these molecules such as insertions, deletions, substitutions and the like, where the presence of one or more perturbations indicates a progression of the cancer.

The above diagnostic approaches can be combined with any one of a wide variety of prognostic and diagnostic protocols known in the art. For example, another embodiment of the invention is directed to methods for observing a coincidence between the expression of 193P1E1B gene and 193P1E1B gene products (or perturbations in 193P1E1B gene and 193P1E1B gene products) and a factor that is associated with malignancy, as a means for diagnosing and prognosticating the status of a tissue sample. A wide variety of factors associated with malignancy can be utilized, such as the expression of genes associated with malignancy (e.g. PSA, PSCA and PSM expression for prostate cancer etc.) as well as gross cytological observations (see, e.g., Bocking et al., 1984, Anal. Quant. Cytol. 6(2):74-88; Epstein, 1995, Hum. Pathol. 26(2):223-9; Thorson et al., 1998, Mod. Pathol. 11(6):543-51; Baisden et al., 1999, Am. J. Surg. Pathol. 23(8):918-24). Methods for observing a coincidence between the expression of 193P1E1B gene and 193P1E1B gene products (or perturbations in 193P1E1B gene and 193P1E1B gene products) and another factor that is associated with malignancy are useful, for example, because the presence of a set of specific factors that coincide with disease provides information crucial for diagnosing and prognosticating the status of a tissue sample.

In one embodiment, methods for observing a coincidence between the expression of 193P1E1B gene and 193P1E1B gene products (or perturbations in 193P1E1B gene and 193P1E1B gene products) and another factor associated with malignancy entails detecting the overexpression of 193P1E1B mRNA or protein in a tissue sample, detecting the overexpression of PSA mRNA or protein in a tissue sample (or PSCA or PSM expression), and observing a coincidence of 193P1E1B mRNA or protein and PSA mRNA or protein overexpression (or PSCA or PSM expression). In a specific embodiment, the expression of 193P1E1B and PSA mRNA in prostate tissue is examined, where the coincidence of 193P1E1B and PSA mRNA overexpression in the sample indicates the existence of prostate cancer, prostate cancer susceptibility or the emergence or status of a prostate tumor.

Methods for detecting and quantifying the expression of 193P1E1B mRNA or protein are described herein, and standard nucleic acid and protein detection and quantification technologies are well known in the art. Standard methods for the detection and quantification of 193P1E1B mRNA include in situ hybridization using labeled 193P1E1B riboprobes, Northern blot and related techniques using 193P1E1B polynucleotide probes, RT-PCR analysis using primers specific for 193P1E1B, and other amplification type detection methods, such as, for example, branched DNA, SISBA, TMA and the like. In a specific embodiment, semi-quantitative RT-PCR is used to detect and quantify 193P1E1B mRNA expression. Any number of primers capable of amplifying 193P1E1B can be used for this purpose, including but not limited to the various primer sets specifically described herein. In a specific embodiment, polyclonal or monoclonal antibodies specifically reactive with the wild-type 193P1E1B protein can be used in an immunohistochemical assay of biopsied tissue.

IX.) Identification of Molecules that Interact with 193P1E1B

The 193P1E1B protein and nucleic acid sequences disclosed herein allow a skilled artisan to identify proteins, small molecules and other agents that interact with 193P1E1B, as well as pathways activated by 193P1E1B via any one of a variety of art accepted protocols. For example, one can utilize one of the so-called interaction trap systems (also referred to as the "two-hybrid assay"). In such systems, molecules interact and reconstitute a transcription factor which directs expression of a reporter gene, whereupon the expression of the reporter gene is assayed. Other systems identify protein-protein interactions in vivo through reconstitution of a eukaryotic transcriptional activator, see, e.g., U.S. Pat. No. 5,955,280 issued 21 Sep. 1999, U.S. Pat. No. 5,925,523 issued 20 Jul. 1999, U.S. Pat. No. 5,846,722 issued 8 Dec. 1998 and U.S. Pat. No. 6,004,746 issued 21 Dec. 1999. Algorithms are also available in the art for genome-based predictions of protein function (see, e.g., Marcotte, et al., Nature 402: 4 Nov. 1999, 83-86).

Alternatively one can screen peptide libraries to identify molecules that interact with 193P1E1B protein sequences. In such methods, peptides that bind to 193P1E1B are identified by screening libraries that encode a random or controlled collection of amino acids. Peptides encoded by the libraries are expressed as fusion proteins of bacteriophage coat proteins, the bacteriophage particles are then screened against the 193P1El B protein(s).

Accordingly, peptides having a wide variety of uses, such as therapeutic, prognostic or diagnostic reagents, are thus identified without any prior information on the structure of the expected ligand or receptor molecule. Typical peptide libraries and screening methods that can be used to identify molecules that interact with 193P1E1B protein sequences are disclosed for example in U.S. Pat. No. 5,723,286 issued 3 Mar. 1998 and U.S. Pat. No. 5,733,731 issued 31 Mar. 1998.

Alternatively, cell lines that express 193P1E1B are used to identify protein-protein interactions mediated by 193P1E1B. Such interactions can be examined using immunoprecipitation techniques (see, e.g., Hamilton B. J., et al. Biochem. Biophys. Res. Commun. 1999, 261:646-51). 193P1E1B protein can be immunoprecipitated from 193P1E1B-expressing cell lines using anti-193P1E1B antibodies. Alternatively, antibodies against His-tag can be used in a cell line engineered to express fusions of 193P1E1B and a His-tag (vectors mentioned above). The immunoprecipitated complex can be examined for protein association by procedures such as Western blotting, $^{35}$S-methionine labeling of proteins, protein microsequencing, silver staining and two-dimensional gel electrophoresis.

Small molecules and ligands that interact with 193P1E1B can be identified through related embodiments of such screening assays. For example, small molecules can be identified that interfere with protein function, including molecules that interfere with 193P1E1B's ability to mediate phosphorylation and de-phosphorylation, interaction with DNA or RNA molecules as an indication of regulation of cell cycles, second messenger signaling or tumorigenesis. Similarly, small molecules that modulate 193P1E1B-related ion channel, protein pump, or cell communication functions are identified and used to treat patients that have a cancer that expresses 193P1E1B (see, e.g., Hille, B., Ionic Channels of Excitable Membranes $2^{nd}$Ed., Sinauer Assoc., Sunderland, Mass., 1992). Moreover, ligands that regulate 193P1E1B function can be identified based on their ability to bind 193P1E1B and activate a reporter construct. Typical methods are discussed for example in U.S. Pat. No. 5,928,868 issued 27 Jul. 1999, and include methods for forming hybrid ligands in which at least one ligand is a small molecule. In an illustrative embodiment, cells engineered to express a fusion protein of 193P1E1B and a DNA-binding protein are used to co-express a fusion protein of a hybrid ligand/small molecule and a cDNA library transcriptional activator protein. The cells further contain a reporter gene, the expression of which is conditioned on the proximity of the first and second fusion proteins to each other, an event that occurs only if the hybrid ligand binds to target sites on both hybrid proteins. Those cells that express the reporter gene are selected and the unknown small molecule or the unknown ligand is identified. This method provides a means of identifying modulators which activate or inhibit 193P1E1B.

An embodiment of this invention comprises a method of screening for a molecule that interacts with an 193P1E1B amino acid sequence shown in FIG. 2 or FIG. 3, comprising the steps of contacting a population of molecules with a 193P1E1B amino acid sequence, allowing the population of molecules and the 193P1E1B amino acid sequence to interact under conditions that facilitate an interaction, determining the presence of a molecule that interacts with the 193P1E1B amino acid sequence, and then separating molecules that do not interact with the 193P1E1B amino acid sequence from molecules that do. In a specific embodiment, the method further comprises purifying, characterizing and identifying a molecule that interacts with the 193P1E1B amino acid sequence. The identified molecule can be used to modulate a function performed by 193P1E1B. In a preferred embodiment, the 193P1E1B amino acid sequence is contacted with a library of peptides.

X.) Therapeutic Methods and Compositions

The identification of 193P1E1B as a protein that is normally expressed in a restricted set of tissues, but which is also expressed in prostate and other cancers, opens a number of therapeutic approaches to the treatment of such cancers. As contemplated herein, 193P1E1B functions as a transcription factor involved in activating tumor-promoting genes or repressing genes that block tumorigenesis.

Accordingly, therapeutic approaches that inhibit the activity of a 193P1E1B protein are useful for patients suffering from a cancer that expresses 193P1E1B. These therapeutic approaches generally fall into two classes. One class comprises various methods for inhibiting the binding or association of a 193P1E1B protein with its binding partner or with other proteins. Another class comprises a variety of methods for inhibiting the transcription of a 193P1E1B gene or translation of 193P1E1B mRNA.

X.A.) Anti-Cancer Vaccines

The invention provides cancer vaccines comprising a 193P1E1B-related protein or 193P1E1B-related nucleic acid. In view of the expression of 193P1E1B, cancer vaccines prevent and/or treat 193P1E1B-expressing cancers with minimal or no effects on non-target tissues. The use of a tumor antigen in a vaccine that generates humoral and/or cell-mediated immune responses as anti-cancer therapy is well known in the art and has been employed in prostate cancer using human PSMA and rodent PAP immunogens (Hodge et al., 1995, Int. J. Cancer 63:231-237; Fong et al., 1997, J. Immunol. 159:3113-3117).

Such methods can be readily practiced by employing a 193P1E1B-related protein, or an 193P1E1B-encoding nucleic acid molecule and recombinant vectors capable of expressing and presenting the 193P1E1B immunogen (which typically comprises a number of antibody or T cell epitopes). Skilled artisans understand that a wide variety of vaccine systems for delivery of immunoreactive epitopes are known in the art (see, e.g., Heryln et al., Ann Med 1999 February 31(1):66-78; Maruyama et al., Cancer Immunol Immunother 2000 June 49(3):123-32) Briefly, such methods of generating an immune response (e.g. humoral and/or cell-mediated) in a mammal, comprise the steps of: exposing the mammal's immune system to an immunoreactive epitope (e.g. an epitope present in a 193P1E1B protein shown in FIG. 3 or analog or homolog thereof) so that the mammal generates an immune response that is specific for that epitope (e.g. generates antibodies that specifically recognize that epitope). In a preferred method, a 193P1E1B immunogen contains a biological motif, see e.g., Tables V-XVIII, XXVI, and XXVII, or a peptide of a size range from 193P1E1B indicated in FIG. 5, FIG. 6, FIG. 7, FIG. 8, and FIG. 9.

The entire 193P1E1B protein, immunogenic regions or epitopes thereof can be combined and delivered by various means. Such vaccine compositions can include, for example, lipopeptides (e.g., Vitiello, A. et al., *J. Clin. Invest.* 95:341, 1995), peptide compositions encapsulated in poly(DL-lactide-co-glycolide) ("PLG") microspheres (see, e.g., Eldridge, et al., *Molec. Immunol.* 28:287-294, 1991: Alonso et al., *Vaccine* 12:299-306, 1994; Jones et al., *Vaccine* 13:675-681, 1995), peptide compositions contained in immune stimulating complexes (ISCOMS) (see, e.g., Takahashi et al., *Nature* 344:873-875, 1990; Hu et al., *Clin Exp Immunol.* 113:235-243, 1998), multiple antigen peptide systems (MAPs) (see e.g., Tam, J. P., *Proc. Natl. Acad. Sci. U.S.A.* 85:5409-5413, 1988; Tam, J. P., *J. Immunol. Methods* 196:17-32, 1996), peptides formulated as multivalent peptides; peptides for use in ballistic delivery systems, typically crystallized peptides, viral delivery vectors (Perkus, M. E. et al., In: *Concepts in vaccine development*, Kaufmann, S. H. E., ed., p. 379, 1996; Chakrabarti, S. et al., *Nature* 320:535, 1986; Hu, S. L. et al., *Nature* 320:537, 1986; Kieny, M.-P. et al., *AIDS Bio/Technology* 4:790, 1986; Top, F. H. et al., *J. Infect. Dis.* 124:148, 1971; Chanda, P. K. et al., *Virology* 175:535, 1990), particles of viral or synthetic origin (e.g., Kofler, N. et al., *J. Immunol. Methods.* 192:25, 1996; Eldridge, J. H. et al., *Sem. Hematol.* 30:16, 1993; Falo, L. D., Jr. et al., *Nature Med.* 7:649, 1995), adjuvants (Warren, H. S., Vogel, F. R., and Chedid, L. A. *Annu. Rev. Immunol.* 4:369, 1986; Gupta, R. K. et al., *Vaccine* 11:293, 1993), liposomes (Reddy, R. et al., *J. Immunol.* 148: 1585, 1992; Rock, K. L., *Immunol. Today* 17:131, 1996), or, naked or particle absorbed cDNA (Ulmer, J. B. et al., *Science* 259:1745, 1993; Robinson, H. L., Hunt, L. A., and Webster, R. G., *Vaccine* 11:957, 1993; Shiver, J. W. et al., In: *Concepts in vaccine development*, Kaufmann, S. H. E., ed., p. 423, 1996; Cease, K. B., and Berzofsky, J. A.,*Annu. Rev. Immunol.* 12:923, 1994 and Eldridge, J. H. et al., *Sem. Hematol.* 30:16, 1993). Toxin-targeted delivery technologies, also known as receptor mediated targeting, such as those of Avant Immunotherapeutics, Inc. (Needham, Mass.) may also be used.

In patients with 193P1E1B-associated cancer, the vaccine compositions of the invention can also be used in conjunction with other treatments used for cancer, e.g., surgery, chemotherapy, drug therapies, radiation therapies, etc. including use in combination with immune adjuvants such as IL-2, IL-12, GM-CSF, and the like.

Cellular Vaccines:

CTL epitopes can be determined using specific algorithms to identify peptides within 193P1E1B protein that bind corresponding HLA alleles (see e.g., Table IV; Epimer™ and Epimatrix™, Brown University; BIMAS, and SYFPEITHI. In a preferred embodiment, a 193P1E1B immunogen contains one or more amino acid sequences identified using techniques well known in the art, such as the sequences shown in Tables V-XVIII, XXVI, and XXVII or a peptide of 8, 9, 10 or 11 amino acids specified by an HLA Class I motif/supermotif (e.g., Table IV (A), Table IV (D), or Table IV (E)) and/or a peptide of at least 9 amino acids that comprises an HLA Class II motif/supermotif (e.g., Table IV (B) or Table IV (C)). As is appreciated in the art, the HLA Class I binding groove is essentially closed ended so that peptides of only a particular size range can fit into the groove and be bound, generally HLA Class I epitopes are 8, 9, 10, or 11 amino acids long. In contrast, the HLA Class II binding groove is essentially open ended; therefore a peptide of about 9 or more amino acids can be bound by an HLA Class II molecule. Due to the binding groove differences between HLA Class I and II, HLA Class I motifs are length specific, i.e., position two of a Class I motif is the second amino acid in an amino to carboxyl direction of the peptide. The amino acid positions in a Class II motif are relative only to each other, not the overall peptide, i.e., additional amino acids can be attached to the amino and/or carboxyl termini of a motif-bearing sequence. HLA Class II epitopes are often 9, 10, 11, 12, 13, 14, 15, 16, 17, 18, 19, 20, 21, 22, 23, 24, or 25 amino acids long, or longer than 25 amino acids.

Antibody-Based Vaccines

A wide variety of methods for generating an immune response in a mammal are known in the art (for example as the first step in the generation of hybridomas). Methods of generating an immune response in a mammal comprise exposing the mammal's immune system to an immunogenic epitope on a protein (e.g. a 193P1E1B protein) so that an immune response is generated. A typical embodiment consists of a method for generating an immune response to 193P1E1B in a host, by contacting the host with a sufficient amount of at least one 193P1E1B cell or cytotoxic T-cell epitope or analog thereof; and at least one periodic interval thereafter re-contacting the host with the 193P1E1B cell or cytotoxic T-cell epitope or analog thereof. A specific embodiment consists of a method of generating an immune response against a 193P1E1B-related protein or a man-made multiepitopic peptide comprising: administering 193P1E1B immunogen (e.g. a 193P1E1B protein or a peptide fragment thereof, an 193P1E1B fusion protein or analog etc.) in a vaccine preparation to a human or another mammal. Typically, such vaccine preparations further contain a suitable adjuvant (see, e.g., U.S. Pat. No. 6,146,635) or a universal helper epitope such as a PADRE™ peptide (Epimmune Inc., San Diego, Calif.; see, e.g., Alexander et al., J. Immunol. 2000 164(3); 164(3): 1625-1633; Alexander et al., Immunity 1994 1(9): 751-761 and Alexander et al., Immunol. Res. 1998 18(2): 79-92). An alternative method comprises generating an immune response in an individual against a 193P1E1B immunogen by: administering in vivo to muscle or skin of the individual's body a DNA molecule that comprises a DNA sequence that encodes an 193P1E1B immunogen, the DNA sequence operatively linked to regulatory sequences which control the expression of the DNA sequence; wherein the DNA molecule is taken up by cells, the DNA sequence is expressed in the cells and an immune response is generated against the immunogen (see, e.g., U.S. Pat. No. 5,962,428). Optionally a genetic vaccine facilitator such as anionic lipids; saponins; lectins; estrogenic compounds; hydroxylated lower alkyls; dimethyl sulfoxide; and urea is also administered. In addition, an antiidiotypic antibody can be administered that mimics 193P1E1B, in order to generate a response to the target antigen.

Nucleic Acid Vaccines:

Vaccine compositions of the invention include nucleic acid-mediated modalities. DNA or RNA that encode protein(s) of the invention can be administered to a patient. Genetic immunization methods can be employed to generate prophylactic or therapeutic humoral and cellular immune responses directed against cancer cells expressing 193P1E1B. Constructs comprising DNA encoding a 193P1E1B-related protein/immunogen and appropriate regulatory sequences can be injected directly into muscle or skin of an individual, such that the cells of the muscle or skin take-up the construct and express the encoded 193P1E1B protein/immunogen. Alternatively, a vaccine comprises a 193P1E1B-related protein. Expression of the 193P1E1B-related protein immunogen results in the generation of prophylactic or therapeutic humoral and cellular immunity against cells that bear a 193P1E1B protein. Various prophylactic and therapeutic genetic immunization techniques known in the art can be used. Nucleic acid-based delivery is described, for instance, in Wolff et. al., Science 247:1465 (1990) as well as U.S. Pat. Nos. 5,580,859; 5,589,466; 5,804,566; 5,739,118; 5,736,524; 5,679,647; WO 98/04720. Examples of DNA-based delivery technologies include "naked DNA", facilitated (bupivicaine, polymers, peptide-mediated) delivery, cationic lipid complexes, and particle-mediated ("gene gun") or pressure-mediated delivery (see, e.z, U.S. Pat. No. 5,922, 687).

For therapeutic or prophylactic immunization purposes, proteins of the invention can be expressed via viral or bacterial vectors. Various viral gene delivery systems that can be used in the practice of the invention include, but are not limited to, vaccinia, fowlpox, canarypox, adenovirus, influenza, poliovirus, adeno-associated virus, lentivirus, and sindbis virus (see, e.g., Restifo, 1996, Curr. Opin. Immunol. 8:658-663; Tsang et al. J. Natl. Cancer Inst. 87:982-990 (1995)). Non-viral delivery systems can also be employed by introducing naked DNA encoding a 193P1E1B-related protein into the patient (e.g., intramuscularly or intradermally) to induce an anti-tumor response.

Vaccinia virus is used, for example, as a vector to express nucleotide sequences that encode the peptides of the invention. Upon introduction into a host, the recombinant vaccinia virus expresses the protein immunogenic peptide, and thereby elicits a host immune response. Vaccinia vectors and methods useful in immunization protocols are described in, e.g., U.S. Pat. No. 4,722,848. Another vector is BCG (Bacille Calmette Guerin). BCG vectors are described in Stover et al., Nature 351:456-460 (1991). A wide variety of other vectors useful for therapeutic administration or immunization of the peptides of the invention, e.g. adeno and adeno-associated virus vectors, retroviral vectors, Salmonella typhi vectors, detoxified anthrax toxin vectors, and the like, will be apparent to those skilled in the art from the description herein.

Thus, gene delivery systems are used to deliver a 193P1E1B-related nucleic acid molecule. In one embodiment, the full-length human 193P1E1B cDNA is employed. In another embodiment, 193P1E1B nucleic acid molecules encoding specific cytotoxic T lymphocyte (CTL) and/or antibody epitopes are employed.

Ex vivo Vaccines

Various ex vivo strategies can also be employed to generate an immune response. One approach involves the use of antigen presenting cells (APCs) such as dendritic cells (DC) to present 193P1E1B antigen to a patient's immune system. Dendritic cells express MHC class I and II molecules, B7 co-stimulator, and IL-12, and are thus highly specialized antigen presenting cells. In prostate cancer, autologous dendritic cells pulsed with peptides of the prostate-specific membrane antigen (PSMA) are being used in a Phase I clinical trial to stimulate prostate cancer patients' immune systems (Tjoa et al., 1996, Prostate 28:65-69; Murphy et al., 1996, Prostate 29:371-380). Thus, dendritic cells can be used to present 193P1E1B peptides to T cells in the context of MHC class I or II molecules. In one embodiment, autologous dendritic cells are pulsed with 193P1E1B peptides capable of binding to MHC class I and/or class II molecules. In another embodiment, dendritic cells are pulsed with the complete 193P1E1B protein. Yet another embodiment involves engineering the overexpression of a 193P1E1B gene in dendritic cells using various implementing vectors known in the art, such as adenovirus (Arthur et al., 1997, Cancer Gene Ther. 4:17-25), retrovirus (Henderson et al., 1996, Cancer Res. 56:3763-3770), lentivirus, adeno-associated virus, DNA transfection (Ribas et al., 1997, Cancer Res. 57:2865-2869), or tumor-derived RNA transfection (Ashley et al., 1997, J. Exp. Med. 186: 1177-1182). Cells that express 193P1E1B can also be engineered to express immune modulators, such as GM-CSF, and used as immunizing agents.

X.B.) 193P1E1B as a Target for Antibody-Based Therapy

193P1E1B is an attractive target for antibody-based therapeutic strategies. A number of antibody strategies are known in the art for targeting both extracellular and intracellular molecules (see, e.g., complement and ADCC mediated killing as well as the use of intrabodies). Because 193P1E1B is expressed by cancer cells of various lineages relative to corresponding normal cells, systemic administration of 193P1E1B-immunoreactive compositions are prepared that exhibit excellent sensitivity without toxic, non-specific and/ or non-target effects caused by binding of the immunoreactive composition to non-target organs and tissues. Antibodies specifically reactive with domains of 193P1E1B are useful to treat 193P1E1B-expressing cancers systemically, either as conjugates with a toxin or therapeutic agent, or as naked antibodies capable of inhibiting cell proliferation or function.

193P1E1B antibodies can be introduced into a patient such that the antibody binds to 193P1E1B and modulates a function, such as an interaction with a binding partner, and consequently mediates destruction of the tumor cells and/or inhibits the growth of the tumor cells. Mechanisms by which such antibodies exert a therapeutic effect can include complement-mediated cytolysis, antibody-dependent cellular cytotoxicity, modulation of the physiological function of 193P1E1B, inhibition of ligand binding or signal transduction pathways, modulation of tumor cell differentiation, alteration of tumor angiogenesis factor profiles, and/or apoptosis.

Those skilled in the art understand that antibodies can be used to specifically target and bind immunogenic molecules such as an immunogenic region of a 193P1E1B sequence shown in FIG. 2 or FIG. 3. In addition, skilled artisans understand that it is routine to conjugate antibodies to cytotoxic agents (see, e.g., Slevers et al. *Blood* 93:11 3678-3684 (Jun. 1, 1999)). When cytokotic and/or therapeutic agents are delivered directly to cells, such as by conjugating them to antibodies specific for a molecule expressed by that cell (e.g. 193P1E1B), the cytotoxic agent will exert its known biological effect (i.e. cytotoxicity) on those cells.

A wide variety of compositions and methods for using antibody-cytotoxic agent conjugates to kill cells are known in the art. In the context of cancers, typical methods entail administering to an animal having a tumor a biologically effective amount of a conjugate comprising a selected cytotoxic and/or therapeutic agent linked to a targeting agent (e.g. an anti-193P1E1B antibody) that binds to a marker (e.g. 193P1E1B) expressed, accessible to binding or localized on the cell surfaces. A typical embodiment is a method of delivering a cytotoxic and/or therapeutic agent to a cell expressing 193P1E1B, comprising conjugating the cytotoxic agent to an antibody that immunospecifically binds to a 193P1E1B epitope, and, exposing the cell to the antibody-agent conjugate. Another illustrative embodiment is a method of treating an individual suspected of suffering from metastasized cancer, comprising a step of administering parenterally to said individual a pharmaceutical composition comprising a therapeutically effective amount of an antibody conjugated to a cytotoxic and/or therapeutic agent.

Cancer immunotherapy using anti-193P1E1B antibodies can be done in accordance with various approaches that have been successfully employed in the treatment of other types of cancer, including but not limited to colon cancer (Arlen et al., 1998, Crit. Rev. Immunol. 18:133-138), multiple myeloma (Ozaki et al., 1997, Blood 90:3179-3186, Tsunenari et al., 1997, Blood 90:2437-2444), gastric cancer (Kasprzyk et al., 1992, Cancer Res. 52:2771-2776), B-cell lymphoma (Funakoshi et al., 1996, J. Immunother. Emphasis Tumor 1 mmol. 19:93-101), leukemia (Zhong et al., 1996, Leuk. Res. 20:581-589), colorectal cancer (Moun et al., 1994, Cancer Res. 54:6160-6166; Velders et al., 1995, Cancer Res. 55:4398-4403), and breast cancer (Shepard et al., 1991, J. Clin. Immunol. 11:117-127). Some therapeutic approaches involve conjugation of naked antibody to a toxin or radioisotope, such as the conjugation of $Y^{91}$ or $I^{131}$ to anti-CD20 antibodies (e.g., Zevalin™, IDEC Pharmaceuticals Corp. or Bexxar™, Coulter Pharmaceuticals), while others involve co-administration of antibodies and other therapeutic agents, such as Herceptin™ (trastuzumab) with paclitaxel (Genentech, Inc.). The antibodies can be conjugated to a therapeutic agent. To treat prostate cancer, for example, 193P1E1B antibodies can be administered in conjunction with radiation, chemotherapy or hormone ablation. Also, antibodies can be conjugated to a toxin such as calicheamicin (e.g., Mylotarg™, Wyeth-Ayerst, Madison, N.J., a recombinant humanized $IgG_4$ kappa antibody conjugated to antitumor antibiotic calicheamicin) or a maytansinoid (e.g., taxane-based Tumor-Activated Prodrug, TAP, platform, ImmunoGen, Cambridge, Mass., also see e.g., U.S. Pat. No. 5,416,064).

Although 193P1E1B antibody therapy is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very Well. Fan et al. (Cancer Res. 53:4637-4642, 1993), Prewett et al. (International J. of Onco. 9:217-224, 1996), and Hancock et al. (Cancer Res. 51:4575-4580, 1991) describe the use of various antibodies together with chemotherapeutic agents.

Although 193P1E1B antibody therapy is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well.

Cancer patients can be evaluated for the presence and level of 193P1E1B expression, preferably using immunohistochemical assessments of tumor tissue, quantitative 193P1E1B imaging, or other techniques that reliably indicate the presence and degree of 193P1E1B expression. Immunohistochemical analysis of tumor biopsies or surgical specimens is preferred for this purpose. Methods for immunohistochemical analysis of tumor tissues are well known in the art.

Anti-193P1E1B monoclonal antibodies that treat prostate and other cancers include those that initiate a potent immune response against the tumor or those that are directly cytotoxic. In this regard, anti-193P1E1B monoclonal antibodies (mAbs) can elicit tumor cell lysis by either complement-mediated or antibody-dependent cell cytotoxicity (ADCC) mechanisms, both of which require an intact Fc portion of the immunoglobulin molecule for interaction with effector cell Fc receptor sites on complement proteins. In addition, anti-193P1E1B mAbs that exert a direct biological effect on tumor growth are useful to treat cancers that express 193P1E1B. Mechanisms by which directly cytotoxic mAbs act include: inhibition of cell growth, modulation of cellular differentiation, modulation of tumor angiogenesis factor profiles, and the induction of apoptosis. The mechanism(s) by which a particular anti-193P1E1B mAb exerts an anti-tumor effect is evaluated using any number of in vitro assays that evaluate cell death such as ADCC, ADMMC, complement-mediated cell lysis, and so forth, as is generally known in the art.

In some patients, the use of murine or other non-human monoclonal antibodies, or human/mouse chimeric mAbs can induce moderate to strong immune responses against the non-human antibody. This can result in clearance of the antibody from circulation and reduced efficacy. In the most severe cases, such an immune response can lead to the extensive formation of immune complexes which, potentially, can cause renal failure. Accordingly, preferred monoclonal antibodies used in the therapeutic methods of the invention are those that are either fully human or humanized and that bind specifically to the target 193P1E1B antigen with high affinity but exhibit low or no antigenicity in the patient.

Therapeutic methods of the invention contemplate the administration of single anti-193P1E1B mAbs as well as combinations, or cocktails, of different mAbs. Such mAb cocktails can have certain advantages inasmuch as they contain mAbs that target different epitopes, exploit different effector mechanisms or combine directly cytotoxic mAbs with mAbs that rely on immune effector functionality. Such mAbs in combination can exhibit synergistic therapeutic effects. In addition, anti-193P1E1B mAbs can be administered concomitantly with other therapeutic modalities, including but not limited to various chemotherapeutic agents, androgen-blockers, immune modulators (e.g., IL-2, GM-CSF), surgery or radiation. The anti-193P1E1B mAbs are administered in their "naked" or unconjugated form, or can have a therapeutic agent(s) conjugated to them.

Anti-193P1E1B antibody formulations are administered via any route capable of delivering the antibodies to a tumor cell. Routes of administration include, but are not limited to, intravenous, intraperitoneal, intramuscular, intratumor, intradermal, and the like. Treatment generally involves repeated administration of the anti-193P1E1B antibody preparation, via an acceptable route of administration such as intravenous injection (IV), typically at a dose in the range of about 0.1, 0.2, 0.3, 0.4, 0.5, 0.6, 0.7, 0.8, 0.9., 1, 2, 3, 4, 5, 6, 7, 8, 9, 10, 15, 20, or 25 mg/kg body weight. In general, doses in the range of 10-1000 mg mAb per week are effective and well tolerated.

Based on clinical experience with the Herceptin™ mAb in the treatment of metastatic breast cancer, an initial loading dose of approximately 4 mg/kg patient body weight IV, followed by weekly doses of about 2 mg/kg IV of the anti-193P1E1B mAb preparation represents an acceptable dosing regimen. Preferably, the initial loading dose is administered as a 90 minute or longer infusion. The periodic maintenance dose is administered as a 30 minute or longer infusion, provided the initial dose was well tolerated. As appreciated by those of skill in the art, various factors can influence the ideal dose regimen in a particular case. Such factors include, for example, the binding affinity and half life of the Ab or mAbs used, the degree of 193P1E1B expression in the patient, the extent of circulating shed 193P1E1B antigen, the desired steady-state antibody concentration level, frequency of treatment, and the influence of chemotherapeutic or other agents used in combination with the treatment method of the invention, as well as the health status of a particular patient.

Optionally, patients should be evaluated for the levels of 193P1E1B in a given sample (e.g. the levels of circulating 193P1E1B antigen and/or 193P1E1B expressing cells) in order to assist in the determination of the most effective dosing regimen, etc. Such evaluations are also used for monitoring purposes throughout therapy, and are useful to gauge therapeutic success in combination with the evaluation of other parameters (for example, urine cytology and/or immunoCyt levels in bladder cancer therapy, or by analogy, serum PSA levels in prostate cancer therapy).

Anti-idiotypic anti-193P1E1B antibodies can also be used in anti-cancer therapy as a vaccine for inducing an immune response to cells expressing a 193P1E1B-related protein. In particular, the generation of anti-idiotypic antibodies is well known in the art; this methodology can readily be adapted to generate anti-idiotypic anti-193P1E1B antibodies that mimic an epitope on a 193P1E1B-related protein (see, for example, Wagner et al., 1997, Hybridoma 16: 33-40; Foon et al., 1995, J. Clin. Invest. 96:334-342; Herlyn et al., 1996, Cancer Immunol. Immunother. 43:65-76). Such an anti-idiotypic antibody can be used in cancer vaccine strategies.

X.C.) 193P1E1B as a Target for Cellular Immune Responses

Vaccines and methods of preparing vaccines that contain an immunogenically effective amount of one or more HLA-binding peptides as described herein are further embodiments of the invention. Furthermore, vaccines in accordance with the invention encompass compositions of one or more of the claimed peptides. A peptide can be present in a vaccine individually. Alternatively, the peptide can exist as a homopolymer comprising multiple copies of the same peptide, or as a heteropolymer of various peptides. Polymers have the advantage of increased immunological reaction and, where different peptide epitopes are used to make up the polymer, the additional ability to induce antibodies and/or CTLs that react with different antigenic determinants of the pathogenic organism or tumor-related peptide targeted for an immune response. The composition can be a naturally occurring region of an antigen or can be prepared, e.g., recombinantly or by chemical synthesis.

Carriers that can be used with vaccines of the invention are well known in the art, and include, e.g., thyroglobulin, albumins such as human serum albumin, tetanus toxoid, polyamino acids such as poly L-lysine, poly L-glutamic acid, influenza, hepatitis B virus core protein, and the like. The vaccines can contain a physiologically tolerable (i.e., acceptable) diluent such as water, or saline, preferably phosphate buffered saline. The vaccines also typically include an adjuvant. Adjuvants such as incomplete Freund's adjuvant, aluminum phosphate, aluminum hydroxide, or alum are examples of materials well known in the art. Additionally, as disclosed herein, CTL responses can be primed by conjugating peptides of the invention to lipids, such as tripalmitoyl-S-glycerylcysteinlyseryl-serine ($P_3CSS$). Moreover, an adjuvant such as a synthetic cytosine-phosphorothiolated-guanine-containing (CpG) oligonucleotides has been found to increase CTL responses 10- to 100-fold. (see, e.g. Davila and Celis *J. Immunol.* 165:539-547 (2000))

Upon immunization with a peptide composition in accordance with the invention, via injection, aerosol, oral, transdermal, transmucosal, intrapleural, intrathecal, or other suitable routes, the immune system of the host responds to the vaccine by producing large amounts of CTLs and/or HTLs specific for the desired antigen. Consequently, the host becomes at least partially immune to later development of cells that express or overexpress 193P1E1B antigen, or derives at least some therapeutic benefit when the antigen was tumor-associated.

In some embodiments, it may be desirable to combine the class I peptide components with components that induce or facilitate neutralizing antibody and or helper T cell responses directed to the target antigen. A preferred embodiment of such a composition comprises class I and class II epitopes in accordance with the invention. An alternative embodiment of such a composition comprises a class I and/or class II epitope in accordance with the invention, along with a cross reactive HTL epitope such as PADRE™ (Epimmune, San Diego, Calif.) molecule (described e.g., in U.S. Pat. No. 5,736,142).

A vaccine of the invention can also include antigen-presenting cells (APC), such as dendritic cells (DC), as a vehicle to present peptides of the invention. Vaccine compositions can be created in vitro, following dendritic cell mobilization and harvesting, whereby loading of dendritic cells occurs in vitro. For example, dendritic cells are transfected, e.g., with a minigene in accordance with the invention, or are pulsed with peptides. The dendritic cell can then be administered to a patient to elicit immune responses in vivo. Vaccine compositions, either DNA- or peptide-based, can also be administered in vivo in combination with dendritic cell mobilization whereby loading of dendritic cells occurs in vivo.

Preferably, the following principles are utilized when selecting an array of epitopes for inclusion in a polyepitopic composition for use in a vaccine, or for selecting discrete epitopes to be included in a vaccine and/or to be encoded by nucleic acids such as a minigene. It is preferred that each of the following principles be balanced in order to make the selection. The multiple epitopes to be incorporated in a given vaccine composition may be, but need not be, contiguous in sequence in the native antigen from which the epitopes are derived.

1.) Epitopes are selected which, upon administration, mimic immune responses that have been observed to be correlated with tumor clearance. For HLA Class I this includes 3-4 epitopes that come from at least one tumor associated antigen (TAA). For HLA Class II a similar rationale is employed; again 3-4 epitopes are selected from at least one TAA (see, e.g., Rosenberg et al., *Science* 278:1447-1450). Epitopes from one TAA may be used in combination with epitopes from one or more additional TAAs to produce a vaccine that targets tumors with varying expression patterns of frequently-expressed TAAs.

2.) Epitopes are selected that have the requisite binding affinity established to be correlated with immunogenicity: for HLA Class I an $IC_{50}$ of 500 nM or less, often 200 nM or less; and for Class II an $IC_{50}$ of 1000 nM or less.

3.) Sufficient supermotif bearing-peptides, or a sufficient array of allele-specific motif-bearing peptides, are selected to give broad population coverage. For example, it is preferable to have at least 80% population coverage. A Monte Carlo analysis, a statistical evaluation known in the art, can be employed to assess the breadth, or redundancy of, population coverage.

4.) When selecting epitopes from cancer-related antigens it is often useful to select analogs because the patient may have developed tolerance to the native epitope.

5.) Of particular relevance are epitopes referred to as "nested epitopes." Nested epitopes occur where at least two epitopes overlap in a given peptide sequence. A nested peptide sequence can comprise B cell, HLA class I and/or HLA class II epitopes. When providing nested epitopes, a general objective is to provide the greatest number of epitopes per sequence. Thus, an aspect is to avoid providing a peptide that is any longer than the amino terminus of the amino terminal epitope and the carboxyl terminus of the carboxyl terminal epitope in the peptide. When providing a multi-epitopic sequence, such as a sequence comprising nested epitopes, it is generally important to screen the sequence in order to insure that it does not have pathological or other deleterious biological properties.

6.) If a polyepitopic protein is created, or when creating a minigene, an objective is to generate the smallest peptide that encompasses the epitopes of interest. This principle is similar, if not the same as that employed when selecting a peptide comprising nested epitopes. However, with an artificial polyepitopic peptide, the size minimization objective is balanced against the need to integrate any spacer sequences between epitopes in the polyepitopic protein. Spacer amino acid residues can, for example, be introduced to avoid junctional epitopes (an epitope recognized by the immune system, not present in the target antigen, and only created by the man-made juxtaposition of epitopes), or to facilitate cleavage between epitopes and thereby enhance epitope presentation. Junctional epitopes are generally to be avoided because the recipient may generate an immune response to that non-native epitope. Of particular concern is a junctional epitope that is a "dominant epitope." A dominant epitope may lead to such a zealous response that immune responses to other epitopes are diminished or suppressed.

7.) Where the sequences of multiple variants of the same target protein are present, potential peptide epitopes can also be selected on the basis of their conservancy. For example, a criterion for conservancy may define that the entire sequence of an HLA class I binding peptide or the entire 9-mer core of a class II binding peptide be conserved in a designated percentage of the sequences evaluated for a specific protein antigen.

X.C.1. Minigene Vaccines

A number of different approaches are available which allow simultaneous delivery of multiple epitopes. Nucleic acids encoding the peptides of the invention are a particularly useful embodiment of the invention. Epitopes for inclusion in a minigene are preferably selected according to the guidelines set forth in the previous section. A preferred means of administering nucleic acids encoding the peptides of the invention uses minigene constructs encoding a peptide comprising one or multiple epitopes of the invention.

The use of multi-epitope minigenes is described below and in, Ishioka et al., *J. Immunol.* 162:3915-3925, 1999; An, L. and Whitton, J. L.; *J. Virol.* 71:2292, 1997; Thomson, S. A. et al., *J. Immunol.* 157:822, 1996; Whitton, J. L. et al., *J. Virol.* 67:348, 1993; Hanke, R. et al., *Vaccine* 16:426, 1998. For example, a multi-epitope DNA plasmid encoding supermotif- and/or motif-bearing epitopes derived 193P1E1B, the PADRE® universal helper T cell epitope (or multiple HTL epitopes from 193P1E1B), and an endoplasmic reticulum-translocating signal sequence can be engineered. A vaccine may also comprise epitopes that are derived from other TAAs.

The immunogenicity of a multi-epitopic minigene can be confirmed in transgenic mice to evaluate the magnitude of CTL induction responses against the epitopes tested. Further, the immunogenicity of DNA-encoded epitopes in vivo can be correlated with the in vitro responses of specific CTL lines against target cells transfected with the DNA plasmid. Thus, these experiments can show that the minigene serves to both: 1.) generate a CTL response and 2.) that the induced CTLs recognized cells expressing the encoded epitopes.

For example, to create a DNA sequence encoding the selected epitopes (minigene) for expression in human cells, the amino acid sequences of the epitopes may be reverse translated. A human codon usage table can be used to guide the codon choice for each amino acid. These epitope-encoding DNA sequences may be directly adjoined, so that when translated, a continuous polypeptide sequence is created. To optimize expression and/or immunogenicity, additional elements can be incorporated into the minigene design. Examples of amino acid sequences that can be reverse translated and included in the minigene sequence include: HLA class I epitopes, HLA class II epitopes, antibody epitopes, a ubiquitination signal sequence, and/or an endoplasmic reticulum targeting signal. In addition, HLA presentation of CTL and HTL epitopes may be improved by including synthetic (e.g. poly-alanine) or naturally-occurring flanking sequences adjacent to the CTL or HTL epitopes; these larger peptides comprising the epitope(s) are within the scope of the invention.

The minigene sequence may be converted to DNA by assembling oligonucleotides that encode the plus and minus strands of the minigene. Overlapping oligonucleotides (30-100 bases long) may be synthesized, phosphorylated, purified and annealed under appropriate conditions using well known techniques. The ends of the oligonucleotides can be joined, for example, using T4 DNA ligase. This synthetic minigene, encoding the epitope polypeptide, can then be cloned into a desired expression vector.

Standard regulatory sequences well known to those of skill in the art are preferably included in the vector to ensure expression in the target cells. Several vector elements are desirable: a promoter with a down-stream cloning site for minigene insertion; a polyadenylation signal for efficient transcription termination; an *E. coli* origin of replication; and an *E. coli* selectable marker (e.g. ampicillin or kanamycin resistance). Numerous promoters can be used for this purpose, e.g., the human cytomegalovirus (hCMV) promoter. See, e.g., U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences and sequences for replication in mammalian cells may also be considered for increasing minigene expression.

Once an expression vector is selected, the minigene is cloned into the polylinker region downstream of the promoter. This plasmid is transformed into an appropriate *E. coli* strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

In addition, immunostimulatory sequences (ISSs or CpGs) appear to play a role in the immunogenicity of DNA vaccines. These sequences may be included in the vector, outside the minigene coding sequence, if desired to enhance immunogenicity.

In some embodiments, a bi-cistronic expression vector which allows production of both the minigene-encoded epitopes and a second protein (included to enhance or decrease immunogenicity) can be used. Examples of proteins or polypeptides that could beneficially enhance the immune response if co-expressed include cytokines (e.g., IL-2, IL-12, GM-CSF), cytokine-inducing molecules (e.g., LeIF), costimulatory molecules, or for HTL responses, pan-DR binding proteins (PADRE™, Epimmune, San Diego, Calif.). Helper (HTL) epitopes can be joined to intracellular targeting signals and expressed separately from expressed CTL epitopes; this allows direction of the HTL epitopes to a cell compartment different than that of the CTL epitopes. If required, this could facilitate more efficient entry of HTL epitopes into the HLA class II pathway, thereby improving HTL induction. In contrast to HTL or CTL induction, specifically decreasing the immune response by co-expression of immunosuppressive molecules (e.g. TGF-β) may be beneficial in certain diseases.

Therapeutic quantities of plasmid DNA can be produced for example, by fermentation in *E. coli*, followed by purification. Aliquots from the working cell bank are used to inoculate growth medium, and grown to saturation in shaker flasks or a bioreactor according to well-known techniques. Plasmid DNA can be purified using standard bioseparation technologies such as solid phase anion-exchange resins supplied by QIAGEN, Inc. (Valencia, Calif.). If required, supercoiled DNA can be isolated from the open circular and linear forms using gel electrophoresis or other methods.

Purified plasmid DNA can be prepared for injection using a variety of formulations. The simplest of these is reconstitution of lyophilized DNA in sterile phosphate-buffer saline (PBS). This approach, known as "naked DNA," is currently being used for intramuscular (IM) administration in clinical trials. To maximize the immunotherapeutic effects of minigene DNA vaccines, an alternative method for formulating purified plasmid DNA may be desirable. A variety of methods have been described, and new techniques may become available. Cationic lipids, glycolipids, and fusogenic liposomes can also be used in the formulation (see, e.g., as described by WO 93/24640; Mannino & Gould-Fogerite, *BioTechniques* 6(7): 682 (1988); U.S. Pat. No. 5,279,833; WO 91/06309; and Felgner, et al., *Proc. Nat'l Acad. Sci. USA* 84:7413 (1987). In addition, peptides and compounds referred to collectively as protective, interactive, non-condensing compounds (PINC) could also be complexed to purified plasmid DNA to influence variables such as stability, intramuscular dispersion, or trafficking to specific organs or cell types.

Target cell sensitization can be used as a functional assay for expression and HLA class I presentation of minigene-encoded CTL epitopes. For example, the plasmid DNA is introduced into a mammalian cell line that is suitable as a target for standard CTL chromium release assays. The transfection method used will be dependent on the final formulation. Electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 ($^{51}$Cr) labeled and used as target cells for epitope-specific CTL lines; cytolysis, detected by $^{51}$Cr release, indicates both production of, and HLA presentation of, minigene-encoded CTL epitopes. Expression of HTL epitopes may be evaluated in an analogous manner using assays to assess HTL activity.

In vivo immunogenicity is a second approach for functional testing of minigene DNA formulations. Transgenic mice expressing appropriate human HLA proteins are immunized with the DNA product. The dose and route of administration are formulation dependent (e.g., IM for DNA in PBS, intraperitoneal (i.p.) for lipid-complexed DNA). Twenty-one days after immunization, splenocytes are harvested and restimulated for one week in the presence of peptides encoding each epitope being tested. Thereafter, for CTL effector cells, assays are conducted for cytolysis of peptide-loaded, $^{51}$Cr-labeled target cells using standard techniques. Lysis of target cells that were sensitized by HLA loaded with peptide epitopes, corresponding to minigene-encoded epitopes, demonstrates DNA vaccine function for in vivo induction of CTLs. Immunogenicity of HTL epitopes is confirmed in transgenic mice in an analogous manner.

Alternatively, the nucleic acids can be administered using ballistic delivery as described, for instance, in U.S. Pat. No. 5,204,253. Using this technique, particles comprised solely of DNA are administered. In a further alternative embodiment, DNA can be adhered to particles, such as gold particles.

Minigenes can also be delivered using other bacterial or viral delivery systems well known in the art, e.g., an expression construct encoding epitopes of the invention can be incorporated into a viral vector such as vaccinia.

X.C.2. Combinations of CTL Peptides with Helper Peptides

Vaccine compositions comprising CTL peptides of the invention can be modified, e.g., analoged, to provide desired attributes, such as improved serum half life, broadened population coverage or enhanced immunogenicity.

For instance, the ability of a peptide to induce CTL activity can be enhanced by linking the peptide to a sequence which contains at least one epitope that is capable of inducing a T helper cell response. Although a CTL peptide can be directly linked to a T helper peptide, often CTL epitope/HTL epitope conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer. When present, the spacer will usually be at least one or two residues, more usually three to six residues and sometimes 10 or more residues. The CTL peptide epitope can be linked to the T helper peptide epitope either directly or via a spacer either at the amino or carboxy terminus of the CTL peptide. The amino terminus of either the immunogenic peptide or the T helper peptide may be acylated.

In certain embodiments, the T helper peptide is one that is recognized by T helper cells present in a majority of a genetically diverse population. This can be accomplished by selecting peptides that bind to many, most, or all of the HLA class II molecules. Examples of such amino acid bind many HLA Class II molecules include sequences from antigens such as tetanus toxoid at positions 830-843 (QYIKANSKFIGITE; SEQ ID NO: _2991_), Plasmodium falciparum circumsporozoite (CS) protein at positions 378-398 (DIEKKIAK-MEKASSVFNVVNS; SEQ ID NO: _2992_), and Streptococcus 18 kD protein at positions 116-131 (GAVDSILGGVATYGAA; SEQ ID NO: 2993_). Other examples include peptides bearing a DR 1-4-7 supermotif, or either of the DR3 motifs.

Alternatively, it is possible to prepare synthetic peptides capable of stimulating T helper lymphocytes, in a loosely HLA-restricted fashion, using amino acid sequences not found in nature (see, e.g., PCT publication WO 95/07707). These synthetic compounds called Pan-DR-binding epitopes (e.g., PADRE™, Epimmune, Inc., San Diego, Calif.) are designed to most preferably bind most HLA-DR (human HLA class II) molecules. For instance, a pan-DR-binding epitope peptide having the formula: aKXVAAWTLKAAa (SEQ ID NO: 2994), where "X" is either cyclohexylalanine, phenylalanine, or tyrosine, and a is either D-alanine or L-alanine, has been found to bind to most HLA-DR alleles, and to stimulate the response of T helper lymphocytes from most individuals, regardless of their HLA type. An alternative of a pan-DR binding epitope comprises all "L" natural amino acids and can be provided in the form of nucleic acids that encode the epitope.

HTL peptide epitopes can also be modified to alter their biological properties. For example, they can be modified to include D-amino acids to increase their resistance to proteases and thus extend their serum half life, or they can be conjugated to other molecules such as lipids, proteins, carbohydrates, and the like to increase their biological activity. For example, a T helper peptide can be conjugated to one or more palmitic acid chains at either the amino or carboxyl termini.

X.C.3. Combinations of CTL Peptides with T Cell Priming Agents

In some embodiments it may be desirable to include in the pharmaceutical compositions of the invention at least one component which primes B lymphocytes or T lymphocytes. Lipids have been identified as agents capable of priming CTL in vivo. For example, palmitic acid residues can be attached to the ε-and α-amino groups of a lysine residue and then linked, e.g., via one or more linking residues such as Gly, Gly-Gly-, Ser, Ser-Ser, or the like, to an immunogenic peptide. The lipidated peptide can then be administered either directly in a micelle or particle, incorporated into a liposome, or emulsified in an adjuvant, e.g., incomplete Freund's adjuvant. In a preferred embodiment, a particularly effective immunogenic composition comprises palmitic acid attached to ε- and α-amino groups of Lys, which is attached via linkage, e.g., Ser-Ser, to the amino terminus of the immunogenic peptide.

As another example of lipid priming of CTL responses, E. coli lipoproteins, such as tripalmitoyl-S-glycerylcysteinly-seryl-serine (P$_3$CSS) can be used to prime virus specific CTL when covalently attached to an appropriate peptide (see, e.g., Deres, et al., Nature 342:561, 1989). Peptides of the invention can be coupled to P$_3$CSS, for example, and the lipopeptide administered to an individual to specifically prime an immune response to the target antigen. Moreover, because the induction of neutralizing antibodies can also be primed with P$_3$CSS-conjugated epitopes, two such compositions can be combined to more effectively elicit both humoral and cell-mediated responses.

X.C.4. Vaccine Compositions Comprising DC Pulsed with CTL and/or HTL Peptides An embodiment of a vaccine composition in accordance with the invention comprises ex vivo administration of a cocktail of epitope-bearing peptides to PBMC, or isolated DC therefrom, from the patient's blood. A pharmaceutical to facilitate harvesting of DC can be used, such as Progenipoietin™ (Pharmacia-Monsanto, St. Louis, Mo.) or GM-CSF/IL-4. After pulsing the DC with peptides and prior to reinfusion into patients, the DC are washed to remove unbound peptides. In this embodiment, a vaccine comprises peptide-pulsed DCs which present the pulsed peptide epitopes complexed with HLA molecules on their surfaces.

The DC can be pulsed ex vivo with a cocktail of peptides, some of which stimulate CTL responses to 193P1E1B. Optionally, a helper T cell (HTL) peptide, such as a natural or artificial loosely restricted HLA Class II peptide, can be included to facilitate the CTL response. Thus, a vaccine in accordance with the invention is used to treat a cancer which expresses or overexpresses 193P1E1B.

X.D. Adoptive Immunotherapy

Antigenic 193P1E1B-related peptides are used to elicit a CTL and/or HTL response ex vivo, as well. The resulting CTL or HTL cells, can be used to treat tumors in patients that do not respond to other conventional forms of therapy, or will not respond to a therapeutic vaccine peptide or nucleic acid in accordance with the invention. Ex vivo CTL or HTL responses to a particular antigen are induced by incubating in tissue culture the patient's, or genetically compatible, CTL or HTL precursor cells together with a source of antigen-presenting cells (APC), such as dendritic cells, and the appropriate immunogenic peptide. After an appropriate incubation time (typically about 7-28 days), in which the precursor cells are activated and expanded into effector cells, the cells are infused back into the patient, where they will destroy (CTL) or facilitate destruction (HTL) of their specific target cell (e.g., a tumor cell). Transfected dendritic cells may also be used as antigen presenting cells.

X.E. Administration of Vaccines for Therapeutic or Prophylactic Purposes

Pharmaceutical and vaccine compositions of the invention are typically used to treat and/or prevent a cancer that expresses or overexpresses 193P1E1B. In therapeutic applications, peptide and/or nucleic acid compositions are administered to a patient in an amount sufficient to elicit an effective B cell, CTL and/or HTL response to the antigen and to cure or at least partially arrest or slow symptoms and/or complications. An amount adequate to accomplish this is defined as "therapeutically effective dose." Amounts effective for this use will depend on, e.g., the particular composition administered, the manner of administration, the stage and severity of the disease being treated, the weight and general state of health of the patient, and the judgment of the prescribing physician.

For pharmaceutical compositions, the immunogenic peptides of the invention, or DNA encoding them, are generally administered to an individual already bearing a tumor that expresses 193P1E1B. The peptides or DNA encoding them can be administered individually or as fusions of one or more peptide sequences. Patients can be treated with the immunogenic peptides separately or in conjunction with other treatments, such as surgery, as appropriate.

For therapeutic use, administration should generally begin at the first diagnosis of 193P1E1B-associated cancer. This is followed by boosting doses until at least symptoms are substantially abated and for a period thereafter. The embodiment of the vaccine composition (i.e., including, but not limited to embodiments such as peptide cocktails, polyepitopic polypeptides, minigenes, or TAA-specific CTLs or pulsed dendritic cells) delivered to the patient may vary according to the stage of the disease or the patient's health status. For example, in a patient with a tumor that expresses 193P1E1B, a vaccine comprising 193P1E1B-specific CTL may be more efficacious in killing tumor cells in patient with advanced disease than alternative embodiments.

It is generally important to provide an amount of the peptide epitope delivered by a mode of administration sufficient to effectively stimulate a cytotoxic T cell response; compositions which stimulate helper T cell responses can also be given in accordance with this embodiment of the invention.

The dosage for an initial therapeutic immunization generally occurs in a unit dosage range where the lower value is about 1, 5, 50, 500, or 1,000 µg and the higher value is about 10,000; 20,000; 30,000; or 50,000 µg. Dosage values for a human typically range from about 500 µg to about 50,000 µg per 70 kilogram patient. Boosting dosages of between about 1.0 µg to about 50,000 µg of peptide pursuant to a boosting regimen over weeks to months may be administered depending upon the patient's response and condition as determined by measuring the specific activity of CTL and HTL obtained from the patient's blood. Administration should continue until at least clinical symptoms or laboratory tests indicate that the neoplasia, has been eliminated or reduced and for a period thereafter. The dosages, routes of administration, and dose schedules are adjusted in accordance with methodologies known in the art.

In certain embodiments, the peptides and compositions of the present invention are employed in serious disease states, that is, life-threatening or potentially life threatening situations. In such cases, as a result of the minimal amounts of extraneous substances and the relative nontoxic nature of the peptides in preferred compositions of the invention, it is possible and may be felt desirable by the treating physician to administer substantial excesses of these peptide compositions relative to these stated dosage amounts.

The vaccine compositions of the invention can also be used purely as prophylactic agents. Generally the dosage for an initial prophylactic immunization generally occurs in a unit dosage range where the lower value is about 1, 5, 50, 500, or 1000 µg and the higher value is about 10,000; 20,000; 30,000; or 50,000 µg. Dosage values for a human typically range from about 500 µg to about 50,000 µg per 70 kilogram patient. This is followed by boosting dosages of between about 1.0 µg to about 50,000 µg of peptide administered at defined intervals from about four weeks to six months after the initial administration of vaccine. The immunogenicity of the vaccine can be assessed by measuring the specific activity of CTL and HTL obtained from a sample of the patient's blood.

The pharmaceutical compositions for therapeutic treatment are intended for parenteral, topical, oral, nasal, intrathecal, or local (e.g. as a cream or topical ointment) administration. Preferably, the pharmaceutical compositions are administered parentally, e.g., intravenously, subcutaneously, intradermally, or intramuscularly. Thus, the invention provides compositions for parenteral administration which comprise a solution of the immunogenic peptides dissolved or suspended in an acceptable carrier, preferably an aqueous carrier.

A variety of aqueous carriers may be used, e.g., water, buffered water, 0.8% saline, 0.3% glycine, hyaluronic acid and the like. These compositions may be sterilized by conventional, well-known sterilization techniques, or may be sterile filtered. The resulting aqueous solutions may be packaged for use as is, or lyophilized, the lyophilized preparation being combined with a sterile solution prior to administration.

The compositions may contain pharmaceutically acceptable auxiliary substances as required to approximate physiological conditions, such as pH-adjusting and buffering agents, tonicity adjusting agents, wetting agents, preservatives, and the like, for example, sodium acetate, sodium lactate, sodium chloride, potassium chloride, calcium chloride, sorbitan monolaurate, triethanolamine oleate, etc.

The concentration of peptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

A human unit dose form of a composition is typically included in a pharmaceutical composition that comprises a human unit dose of an acceptable carrier, in one embodiment an aqueous carrier, and is administered in a volume/quantity that is known by those of skill in the art to be used for administration of such compositions to humans (see, e.g., Remington's Pharmaceutical Sciences, $17^{th}$Edition, A. Gennaro, Editor, Mack Publishing Co., Easton, Pa., 1985). For example a peptide dose for initial immunization can be from about 1 to about 50,000 µg, generally 100-5,000 µg, for a 70 kg patient. For example, for nucleic acids an initial immunization may be performed using an expression vector in the form of naked nucleic acid administered IM (or SC or ID) in the amounts of 0.5-5 mg at multiple sites. The nucleic acid (0.1 to 1000 µg) can also be administered using a gene gun. Following an incubation period of 3-4 weeks, a booster dose is then administered. The booster can be recombinant fowlpox virus administered at a dose of $5\text{-}10^7$ to $5\times10^9$ pfu.

For antibodies, a treatment generally involves repeated administration of the anti-193P1E1B antibody preparation, via an acceptable route of administration such as intravenous injection (UV), typically at a dose in the range of about 0.1 to about 10 mg/kg body weight. In general, doses in the range of 10-500 mg mAb per week are effective and well tolerated. Moreover, an initial loading dose of approximately 4 mg/kg patient body weight IV, followed by weekly doses of about 2 mg/kg IV of the anti-193P1E1B mAb preparation represents an acceptable dosing regimen. As appreciated by those of skill in the art, various factors can influence the ideal dose in a particular case. Such factors include, for example, half life of a composition, the binding affinity of an Ab, the immunogenicity of a substance, the degree of 193P1E1B expression in the patient, the extent of circulating shed 193P1E1B antigen, the desired steady-state concentration level, frequency of treatment, and the influence of chemotherapeutic or other agents used in combination with the treatment method of the invention, as well as the health status of a particular patient. Non-limiting preferred human unit doses are, for example, 500 µg-1 mg, 1 mg-50 mg, 50 mg-100 mg, 100 mg-200 mg, 200 mg-300 mg, 400 mg-500 mg, 500 mg-600 mg, 600 mg-700 mg, 700 mg-800 mg, 800 mg-900 mg, 900 mg-1 g, or 1 mg-700 mg. In certain embodiments, the dose is in a range of 2-5 mg/kg body weight, e.g., with follow on weekly doses of 1-3 mg/kg; 0.5 mg, 1, 2, 3, 4, 5, 6, 7, 8, 9, 10 mg/kg body weight followed, e.g., in two, three or four weeks by weekly doses; 0.5-10 mg/kg body weight, e.g., followed in two, three or four weeks by weekly doses; 225, 250, 275, 300, 325, 350, 375, 400 mg $m^2$ of body area weekly; 1-600 mg $m^2$ of body area weekly; 225-400 mg $m^2$ of body area weekly; these does can be followed by weekly doses for 2, 3, 4, 5, 6, 7, 8, 9, 19, 11, 12 or more weeks.

In one embodiment, human unit dose forms of polynucleotides comprise a suitable dosage range or effective amount that provides any therapeutic effect. As appreciated by one of ordinary skill in the art a therapeutic effect depends on a number of factors, including the sequence of the polynucleotide, molecular weight of the polynucleotide and route of administration. Dosages are generally selected by the physician or other health care professional in accordance with a variety of parameters known in the art, such as severity of symptoms, history of the patient and the like. Generally, for a polynucleotide of about 20 bases, a dosage range may be selected from, for example, an independently selected lower limit such as about 0.1, 0.25, 0.5, 1, 2, 5, 10, 20, 30, 40, 50, 60, 70, 80, 90, 100, 200, 300, 400 or 500 mg/kg up to an independently selected upper limit, greater than the lower limit, of about 60, 80, 100, 200, 300, 400, 500, 750, 1000, 1500, 2000, 3000, 4000, 5000, 6000, 7000, 8000, 9000 or 10,000 mg/kg. For example, a dose may be about any of the following: 0.1 to 100 mg/kg, 0.1 to 50 mg/kg, 0.1 to 25 mg/kg, 0.1 to 10 mg/kg, 1 to 500 mg/kg, 100 to 400 mg/kg, 200 to 300 mg/kg, 1 to 100 mg/kg, 100 to 200 mg/kg, 300 to 400 mg/kg, 400 to 500 mg/kg, 500 to 1000 mg/kg, 500 to 5000 mg/kg, or 500 to 10,000 mg/kg. Generally, parenteral routes of administration may require higher doses of polynucleotide compared to more direct application to the nucleotide to diseased tissue, as do polynucleotides of increasing length.

In one embodiment, human unit dose forms of T-cells comprise a suitable dosage range or effective amount that provides any therapeutic effect. As appreciated by one of ordinary skill in the art, a therapeutic effect depends on a number of factors. Dosages are generally selected by the physician or other health care professional in accordance with a variety of parameters known in the art, such as severity of symptoms, history of the patient and the like. A dose may be about $10^4$ cells to about $10^6$ cells, about $10^6$ cells to about $10^8$ cells, about $10^8$ to about $10^{11}$ cells, or about $10^8$ to about $5\times10^{10}$ cells. A dose may also about $10^6$ cells/$m^2$ to about $10^{10}$ cells/$m^2$, or about $10^6$ cells/$m^2$ to about $10^8$ cells/$m^2$.

Proteins(s) of the invention, and/or nucleic acids encoding the protein(s), can also be administered via liposomes, which may also serve to: 1) target the proteins(s) to a particular tissue, such as lymphoid tissue; 2) to target selectively to diseases cells; or, 3) to increase the half-life of the peptide composition. Liposomes include emulsions, foams, micelles, insoluble monolayers, liquid crystals, phospholipid dispersions, lamellar layers and the like. In these preparations, the peptide to be delivered is incorporated as part of a liposome, alone or in conjunction with a molecule which binds to a receptor prevalent among lymphoid cells, such as monoclonal antibodies which bind to the CD45 antigen, or with other therapeutic or immunogenic compositions. Thus, liposomes either filled or decorated with a desired peptide of the invention can be directed to the site of lymphoid cells, where the liposomes then deliver the peptide compositions. Liposomes for use in accordance with the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka, et al., *Ann. Rev. Biophys. Bioeng.* 9:467 (1980), and U.S. Pat. Nos. 4,235,871, 4,501,728, 4,837,028, and 5,019,369.

For targeting cells of the immune system, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, immunogenic peptides are preferably supplied in finely divided form along with a surfactant and propellant. Typical percentages of peptides are about 0.01%-20% by weight, preferably about 1%-10%. The surfactant must, of course, be nontoxic, and preferably soluble in the propellant. Representative of such agents are the esters or partial esters of fatty acids containing from about 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute about 0.1%-20% by weight of the composition, preferably about 0.25-5%. The balance of the composition is ordinarily propellant. A carrier can also be included, as desired, as with, e.g., lecithin for intranasal delivery.

XI.) Diagnostic and Prognostic Embodiments of 193P1E1B.

As disclosed herein, 193P1E1B polynucleotides, polypeptides, reactive cytotoxic T cells (CTL), reactive helper T cells (HTL) and anti-polypeptide antibodies are used in well known diagnostic, prognostic and therapeutic assays that examine conditions associated with dysregulated cell growth such as cancer, in particular the cancers listed in Table I (see, e.g., both its specific pattern of tissue expression as well as its overexpression in certain cancers as described for example in Example 4).

193P1E1B can be analogized to a prostate associated antigen PSA, the archetypal marker that has been used by medical practitioners for years to identify and monitor the presence of prostate cancer (see, e.g., Merrill et al., J. Urol. 163(2): 503-5120 (2000); Polascik et al., J. Urol. Aug; 162(2):293-306 (1999) and Fortier et al., J. Nat. Cancer Inst. 91(19): 1635-1640(1999)). A variety of other diagnostic markers are also used in similar contexts including p53 and K-ras (see, e.g., Tulchinsky et al., Int J Mol Med 1999 Jul 4(1):99-102 and Minimoto et al., Cancer Detect Prev 2000;24(1):1-12). Therefore, this disclosure of 193P1E1B polynucleotides and polypeptides (as well as 193P1E1B polynucleotide probes and anti-193P1E1B antibodies used to identify the presence of these molecules) and their properties allows skilled artisans to utilize these molecules in methods that are analogous to those used, for example, in a variety of diagnostic assays directed to examining conditions associated with cancer.

Typical embodiments of diagnostic methods which utilize the 193P1E1B polynucleotides, polypeptides, reactive T cells and antibodies are analogous to those methods from well-established diagnostic assays which employ, e.g., PSA polynucleotides, polypeptides, reactive T cells and antibodies. For example, just as PSA polynucleotides are used as probes (for example in Northern analysis, see, e.g., Sharief et al., Biochem. Mol. Biol. Int. 33(3):567-74(1994)) and primers (for example in PCR analysis, see, e.g., Okegawa et al., J. Urol. 163(4): 1189-1190 (2000)) to observe the presence and/or the level of PSA mRNAs in methods of monitoring PSA overexpression or the metastasis of prostate cancers, the 193P1E1B polynucleotides described herein can be utilized in the same way to detect 193P1E1B overexpression or the metastasis of prostate and other cancers expressing this gene. Alternatively, just as PSA polypeptides are used to generate antibodies specific for PSA which can then be used to observe the presence and/or the level of PSA proteins in methods to monitor PSA protein overexpression (see, e.g., Stephan et al., Urology 55(4):560-3 (2000)) or the metastasis of prostate cells (see, e.g., Alanen et al., Pathol. Res. Pract. 192(3):233-7 (1996)), the 193P1E1B polypeptides described herein can be utilized to generate antibodies for use in detecting 193P1E1B overexpression or the metastasis of prostate cells and cells of other cancers expressing this gene.

Specifically, because metastases involves the movement of cancer cells from an organ of origin (such as the lung or prostate gland etc.) to a different area of the body (such as a lymph node), assays which examine a biological sample for the presence of cells expressing 193P1E1B polynucleotides and/or polypeptides can be used to provide evidence of metastasis. For example, when a biological sample from tissue that does not normally contain 193P1E1B-expressing cells (lymph node) is found to contain 193P1E1B-expressing cells such as the 193P1E1B expression seen in LAPC4 and LAPC9, xenografts isolated from lymph node and bone metastasis, respectively, this finding is indicative of metastasis.

Alternatively 193P1E1B polynucleotides and/or polypeptides can be used to provide evidence of cancer, for example, when cells in a biological sample that do not normally express 193P1E1B or express 193P1E1B at a different level are found to express 193P1E1B or have an increased expression of 193P1E1B (see, e.g., the 193P1E1B expression in the cancers listed in Table I and in patient samples etc. shown in the accompanying Figures). In such assays, artisans may further wish to generate supplementary evidence of metastasis by testing the biological sample for the presence of a second tissue restricted marker (in addition to 193P1E1B) such as PSA, PSCA etc. (see, e.g., Alanen et al., Pathol. Res. Pract. 192(3): 233-237 (1996)).

Just as PSA polynucleotide fragments and polynucleotide variants are employed by skilled artisans for use in methods of monitoring PSA, 193P1E1B polynucleotide fragments and polynucleotide variants are used in an analogous manner. In particular, typical PSA polynucleotides used in methods of monitoring PSA are probes or primers which consist of fragments of the PSA cDNA sequence. Illustrating this, primers used to PCR amplify a PSA polynucleotide must include less than the whole PSA sequence to function in the polymerase chain reaction. In the context of such PCR reactions, skilled artisans generally create a variety of different polynucleotide fragments that can be used as primers in order to amplify different portions of a polynucleotide of interest or to optimize amplification reactions (see, e.g., Caetano-Anolles, G. Biotechniques 25(3): 472-476, 478-480 (1998); Robertson et al., Methods Mol. Biol. 98:121-154 (1998)). An additional illustration of the use of such fragments is provided in Example 4, where a 193P1E1B polynucleotide fragment is used as a probe to show the expression of 193P1E1B RNAs in cancer cells. In addition, variant polynucleotide sequences are typically used as primers and probes for the corresponding mRNAs in PCR and Northern analyses (see, e.g., Sawai et al., Fetal Diagn. Ther. 1996 Nov-Dec 11 (6):407-13 and Current Protocols In Molecular Biology, Volume 2, Unit 2, Frederick M. Ausubel et al. eds., 1995)). Polynucleotide fragments and variants are useful in this context where they are capable of binding to a target polynucleotide sequence (e.g., a 193P1E1B polynucleotide shown in FIG. 2 or variant thereof) under conditions of high stringency.

Furthermore, PSA polypeptides which contain an epitope that can be recognized by an antibody or T cell that specifically binds to that epitope are used in methods of monitoring PSA. 193P1E1B polypeptide fragments and polypeptide analogs or variants can also be used in an analogous manner. This practice of using polypeptide fragments or polypeptide variants to generate antibodies (such as anti-PSA antibodies or T cells) is typical in the art with a wide variety of systems such as fusion proteins being used by practitioners (see, e.g., Current Protocols In Molecular Biology, Volume 2, Unit 16, Frederick M. Ausubel et al. eds., 1995). In this context, each epitope(s) functions to provide the architecture with which an antibody or T cell is reactive. Typically, skilled artisans create a variety of different polypeptide fragments that can be used in order to generate immune responses specific for different portions of a polypeptide of interest (see, e.g., U.S. Pat. No. 5,840,501 and 5,939,533). For example it may be preferable to utilize a polypeptide comprising one of the 193P1E1B biological motifs discussed herein or a motif-bearing subsequence which is readily identified by one of skill in the art based on motifs available in the art. Polypeptide fragments, variants or analogs are typically useful in this context as long as they comprise an epitope capable of generating an antibody or T cell specific for a target polypeptide sequence (e.g. a 193P1E1B polypeptide shown in FIG. 3).

As shown herein, the 193P1E1B polynucleotides and polypeptides (as well as the 193P1E1B polynucleotide probes and anti-193P1E1B antibodies or T cells used to identify the presence of these molecules) exhibit specific properties that make them useful in diagnosing cancers such as those listed in Table I. Diagnostic assays that measure the presence of 193P1E1B gene products, in order to evaluate the presence or onset of a disease condition described herein, such as prostate cancer, are used to identify patients for preventive measures or further monitoring, as has been done so successfully with PSA. Moreover, these materials satisfy a need in the art for molecules having similar or complementary characteristics to PSA in situations where, for example, a definite diagnosis of metastasis of prostatic origin cannot be made on the basis of a test for PSA alone (see, e.g., Alanen et al., Pathol. Res. Pract. 192(3): 233-237 (1996)), and consequently, materials such as 193P1E1B polynucleotides and polypeptides (as well as the 193P1E1B polynucleotide probes and anti-193P1E1B antibodies used to identify the presence of these molecules) need to be employed to confirm a metastases of prostatic origin.

Finally, in addition to their use in diagnostic assays, the 193P1E1B polynucleotides disclosed herein have a number of other utilities such as their use in the identification of oncogenetic associated chromosomal abnormalities in the chromosomal region to which the 193P1E1B gene maps (see Example 3 below). Moreover, in addition to their use in diagnostic assays, the 193P1E1B-related proteins and polynucleotides disclosed herein have other utilities such as their use in the forensic analysis of tissues of unknown origin (see, e.g., Takahama K Forensic Sci Int 1996 Jun. 28;80(1-2): 63-9).

Additionally, 193P1E1 B-related proteins or polynucleotides of the invention can be used to treat a pathologic condition characterized by the over-expression of 193P1E1B. For example, the amino acid or nucleic acid sequence of FIG. 2 or FIG. 3, or fragments of either, can be used to generate an immune response to a 193P1E1B antigen. Antibodies or other molecules that react with 193P1E1B can be used to modulate the function of this molecule, and thereby provide a therapeutic benefit.

XII.) Inhibition of 193P1E1B Protein Function

The invention includes various methods and compositions for inhibiting the binding of 193P1E1B to its binding partner or its association with other protein(s) as well as methods for inhibiting 193P1E1B function.

XII.A.) Inhibition of 193P1E1B With Intracellular Antibodies

In one approach, a recombinant vector that encodes single chain antibodies that specifically bind to 193P1E1B are introduced into 193P1E1B expressing cells via gene transfer technologies. Accordingly, the encoded single chain anti-193P1E1B antibody is expressed intracellularly, binds to 193P1E1B protein, and thereby inhibits its function. Methods for engineering such intracellular single chain antibodies are well known. Such intracellular antibodies, also known as "intrabodies", are specifically targeted to a particular compartment within the cell, providing control over where the inhibitory activity of the treatment is focused. This technology has been successfully applied in the art (for review, see Richardson and Marasco, 1995, TIBTECH vol. 13). Intrabodies have been shown to virtually eliminate the expression of otherwise abundant cell surface receptors (see, e.g., Richardson et al., 1995, Proc. Natl. Acad. Sci. USA 92: 3137-3141; Beerli et al., 1994, J. Biol. Chem. 289: 23931-23936; Deshane et al., 1994, Gene Ther. 1: 332-337).

Single chain antibodies comprise the variable domains of the heavy and light chain joined by a flexible linker polypeptide, and are expressed as a single polypeptide. Optionally, single chain antibodies are expressed as a single chain variable region fragment joined to the light chain constant region. Well-known intracellular trafficking signals are engineered into recombinant polynucleotide vectors encoding such single chain antibodies in order to precisely target the intrabody to the desired intracellular compartment. For example, intrabodies targeted to the endoplasmic reticulum (ER) are engineered to incorporate a leader peptide and, optionally, a C-terminal ER retention signal, such as the KDEL amino acid motif. Intrabodies intended to exert activity in the nucleus are engineered to include a nuclear localization signal. Lipid moieties are joined to intrabodies in order to tether the intrabody to the cytosolic side of the plasma membrane. Intrabodies can also be targeted to exert function in the cytosol. For example, cytosolic intrabodies are used to sequester factors within the cytosol, thereby preventing them from being transported to their natural cellular destination.

In one embodiment, intrabodies are used to capture 193P1E1B in the nucleus, thereby preventing its activity within the nucleus. Nuclear targeting signals are engineered into such 193P1E1B intrabodies in order to achieve the desired targeting. Such 193P1E1B intrabodies are designed to bind specifically to a particular 193P1E1B domain. In another embodiment, cytosolic intrabodies that specifically bind to a 193P1E1B protein are used to prevent 193P1E1B from gaining access to the nucleus, thereby preventing it from exerting any biological activity within the nucleus (e.g., preventing 193P1E1B from forming transcription complexes with other factors).

In order to specifically direct the expression of such intrabodies to particular cells, the transcription of the intrabody is placed under the regulatory control of an appropriate tumor-specific promoter and/or enhancer. In order to target intrabody expression specifically to prostate, for example, the PSA promoter and/or promoter/enhancer can be utilized (See, for example, U.S. Pat. No. 5,919,652 issued Jul. 6, 1999).

XII.B.) Inhibition of 193P1E1B with Recombinant Proteins

In another approach, recombinant molecules bind to 193P1E1B and thereby inhibit 193P1E1B function. For example, these recombinant molecules prevent or inhibit 193P1E1B from accessing/binding to its binding partner(s) or associating with other protein(s). Such recombinant molecules can, for example, contain the reactive part(s) of a 193P1E1B specific antibody molecule. In a particular embodiment, the 193P1E1B binding domain of a 193P1E1B binding partner is engineered into a dimeric fusion protein, whereby the fusion protein comprises two 193P1E1B ligand binding domains linked to the Fc portion of a human IgG, such as human IgG1. Such IgG portion can contain, for example, the $C_H2$ and $C_H3$ domains and the hinge region, but not the $C_H1$ domain. Such dimeric fusion proteins are administered in soluble form to patients suffering from a cancer-associated with the expression of 193P1E1B, whereby the dimeric fusion protein specifically binds to 193P1E1B and blocks 193P1E1B interaction with a binding partner. Such dimeric fusion proteins are further combined into multimeric proteins using known antibody linking technologies.

XII.C.) Inhibition of 193P1E1B Transcription or Translation

The present invention also comprises various methods and compositions for inhibiting the transcription of the 193P1E1B gene. Similarly, the invention also provides methods and compositions for inhibiting the translation of 193P1E1B mRNA into protein.

In one approach, a method of inhibiting the transcription of the 193P1E1B gene comprises contacting the 193P1E1B gene with a 193P1E1B antisense polynucleotide. In another approach, a method of inhibiting 193P1E1B mRNA translation comprises contacting a 193P1E1B mRNA with an antisense polynucleotide. In another approach, a 193P1E1B specific ribozyme is used to cleave a 193P1E1B message, thereby inhibiting translation. Such antisense and ribozyme based methods can also be directed to the regulatory regions of the 193P1E1B gene, such as 193P1E1B promoter and/or enhancer elements. Similarly, proteins capable of inhibiting a 193P1E1B gene transcription factor are used to inhibit 193P1E1B mRNA transcription. The various polynucleotides and compositions useful in the aforementioned methods have been described above. The use of antisense and ribozyme molecules to inhibit transcription and translation is well known in the art.

Other factors that inhibit the transcription of 193P1E1B by interfering with 193P1E1B transcriptional activation are also useful to treat cancers expressing 193P1E1B. Similarly, factors that interfere with 193P1E1B processing are useful to treat cancers that express 193P1E1B. Cancer treatment methods utilizing such factors are also within the scope of the invention.

XII.D.) General Considerations for Therapeutic Strategies

Gene transfer and gene therapy technologies can be used to deliver therapeutic polynucleotide molecules to tumor cells synthesizing 193P1E1B (i.e., antisense, ribozyme, polynucleotides encoding intrabodies and other 193P1E1B inhibitory molecules). A number of gene therapy approaches are known in the art. Recombinant vectors encoding 193P1E1B antisense polynucleotides, ribozymes, factors capable of interfering with 193P1E1B transcription, and so forth, can be delivered to target tumor cells using such gene therapy approaches.

The above therapeutic approaches can be combined with any one of a wide variety of surgical, chemotherapy or radiation therapy regimens. The therapeutic approaches of the invention can enable the use of reduced dosages of chemotherapy (or other therapies) and/or less frequent administration, an advantage for all patients and particularly for those that do not tolerate the toxicity of the chemotherapeutic agent well.

The anti-tumor activity of a particular composition (e.g., antisense, ribozyme, intrabody), or a combination of such compositions, can be evaluated using various in vitro and in vivo assay systems. In vitro assays that evaluate therapeutic activity include cell growth assays, soft agar assays and other assays indicative of tumor promoting activity, binding assays capable of determining the extent to which a therapeutic composition will inhibit the binding of 193P1E1B to a binding partner, etc.

In vivo, the effect of a 193P1E1B therapeutic composition can be evaluated in a suitable animal model. For example, xenogenic prostate cancer models can be used, wherein human prostate cancer explants or passaged xenograft tissues are introduced into immune compromised animals, such as nude or SCID mice (Klein et al., 1997, Nature Medicine 3: 402-408). For example, PCT Patent Application WO98/16628 and U.S. Pat. No. 6,107,540 describe various xenograft models of human prostate cancer capable of recapitulating the development of primary tumors, micrometastasis, and the formation of osteoblastic metastases characteristic of late stage disease. Efficacy can be predicted using assays that measure inhibition of tumor formation, tumor regression or metastasis, and the like.

In vivo assays that evaluate the promotion of apoptosis are useful in evaluating therapeutic compositions. In one embodiment, xenografts from tumor bearing mice treated with the therapeutic composition can be examined for the presence of apoptotic foci and compared to untreated control xenograft-bearing mice. The extent to which apoptotic foci are found in the tumors of the treated mice provides an indication of the therapeutic efficacy of the composition.

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences 16th Edition, A. Osal., Ed., 1980).

Therapeutic formulations can be solubilized and administered via any route capable of delivering the therapeutic composition to the tumor site. Potentially effective routes of administration include, but are not limited to, intravenous, parenteral, intraperitoneal, intramuscular, intratumor, intradermal, intraorgan, orthotopic, and the like. A preferred formulation for intravenous injection comprises the therapeutic composition in a solution of preserved bacteriostatic water, sterile unpreserved water, and/or diluted in polyvinylchloride or polyethylene bags containing 0.9% sterile Sodium Chloride for Injection, USP. Therapeutic protein preparations can be lyophilized and stored as sterile powders, preferably under vacuum, and then reconstituted in bacteriostatic water (containing for example, benzyl alcohol preservative) or in sterile water prior to injection.

Dosages and administration protocols for the treatment of cancers using the foregoing methods will vary with the method and the target cancer, and will generally depend on a number of other factors appreciated in the art.

XIII.) Kits

For use in the diagnostic and therapeutic applications described herein, kits are also within the scope of the invention. Such kits can comprise a carrier, package or container that is compartmentalized to receive one or more containers such as vials, tubes, and the like, each of the container(s) comprising one of the separate elements to be used in the method. For example, the container(s) can comprise a probe that is or can be detectably labeled. Such probe can be an antibody or polynucleotide specific for a 193P1E1B-related protein or a 193P1E1B gene or message, respectively. Where the method utilizes nucleic acid hybridization to detect the target nucleic acid, the kit can also have containers containing nucleotide(s) for amplification of the target nucleic acid sequence and/or a container comprising a reporter-means, such as a biotin-binding protein, such as avidin or streptavidin, bound to a reporter molecule, such as an enzymatic, florescent, or radioisotope label. The kit can include all or part of the amino acid sequence of FIG. 2 or FIG. 3 or analogs thereof, or a nucleic acid molecules that encodes such amino acid sequences.

The kit of the invention will typically comprise the container described above and one or more other containers comprising materials desirable from a commercial and user standpoint, including buffers, diluents, filters, needles, syringes, and package inserts with instructions for use.

A label can be present on the container to indicate that the composition is used for a specific therapy or non-therapeutic application, and can also indicate directions for either in vivo or in vitro use, such as those described above. Directions and or other information can also be included on an insert which is included with the kit.

EXAMPLES

Various aspects of the invention are further described and illustrated by way of the several examples that follow, none of which are intended to limit the scope of the invention.

Example 1

SSH-Generated Isolation of a cDNA Fragment of the 193P1E1B Gene

To isolate genes that are 6ver-expressed in prostate cancer we used the Suppression Subtractive Hybridization (SSH) procedure using cDNA derived from prostate cancer xenograft tissues. LAPC-9AD xenograft was obtained from Dr. Charles Sawyers (UCLA) and was generated as described (Klein et al., 1997, Nature Med. 3:402-408; Craft et al., 1999, Cancer Res. 59:5030-5036). LAPC-9AD$^2$ was generated from LAPC-9AD xenograft by growing LAPC-9AD xenograft tissues within a piece of human bone implanted in SCID mice. Tumors were then harvested and subsequently passaged sub-cutaneously into other SCID animals to generate LAPC-9AD$^2$.

The 193P1E1B SSH cDNA sequence was derived from a subtraction consisting of a prostate cancer xenograft LAPC-9AD$^2$ minus prostate cancer xenograft LAPC-9AD. By RT-PCR, the 193P1E1B cDNA was identified as highly expressed in the prostate cancer xenograft pool (LAPC4-AD, LAPC4-AI, LAPC9-AD, LAPC9-AI), bladder cancer pool, kidney cancer pool, colon cancer pool, lung cancer pool, ovary cancer pool, breast cancer pool, metastasis cancer pool, pancreas cancer pool, with low expression observed in the prostate cancer pool, and no expression observed in vital pool 1 (kidney, liver, lung), and in vital pool 2 (stomach, colon, pancreas) (FIG. 10).

The 193P1E1B SSH cDNA of 227 bp is listed in FIG. 1. The full length 193P1E1B cDNAs and ORFs are described in FIG. 2 with the protein sequences listed in FIG. 3.

Materials and Methods

RNA Isolation:

Tumor tissues were homogenized in Trizol reagent (Life Technologies, Gibco BRL) using 10 ml/g tissue or 10 ml/10$^8$ cells to isolate total RNA. Poly A RNA was purified from total RNA using Qiagen's Oligotex mRNA Mini and Midi kits. Total and mRNA were quantified by spectrophotometric analysis (O.D. 260/280 nm) and analyzed by gel electrophoresis.

Oligonucleotides:

The following HPLC purified oligonucleotides were used.

```
DPNCDN (cDNA synthesis primer):  5'TTTTGATCAAGCTT30 3'                              (SEQ ID NO:2995)

Adaptor 1:                       5'CTAATACGACTCACTATAGGGCTCGAGCGGCCGCCCGGGCAG3'    (SEQ ID NO:2996)

3'GGCCCGTCCTAG5'                                   (SEQ ID NO:2997)

Adaptor 2:                       5'GTAATACGACTCACTATAGGGCAGCGTGGTCGCGGCCGAG3'      (SEQ ID NO:2998)

3'CGGCTCCTAG5'                                     (SEQ ID NO:2999)

PCR primer 1:                    5'CTAATACGACTCACTATAGGGC3'                         (SEQ ID NO:3000)

Nested primer (NP)1:             5'TCGAGCGGCCGCCCGGGCAGGA3'                         (SEQ ID NO:3001)

Nested primer (NP)2:             5'AGCGTGGTCGCGGCCGAGGA3'                           (SEQ ID NO:3002)
```

Suppression Subtractive Hybridization:

Suppression Subtractive Hybridization (SSH) was used to identify cDNAs corresponding to genes that may be differentially expressed in prostate cancer. The SSH reaction utilized cDNA from prostate cancer xenograft LAPC-9AD$^2$. The gene 193P1E1B was derived from a prostate cancer xenograft LAPC-9AD$^2$ minus prostate cancer xenograft LAPC-9AD tissues. The SSH DNA sequence (FIG. 1) was identified.

The cDNA derived from prostate cancer xenograft LAPC-9AD tissue was used as the source of the "driver" cDNA, while the cDNA from prostate cancer xenograft LAPC-9AD$^2$ was used as the source of the "tester" cDNA. Double stranded cDNAs corresponding to tester and driver cDNAs were synthesized from 2 μg of poly(A)+ RNA isolated from the relevant tissue, as described above, using CLONTECH's PCR-Select cDNA Subtraction Kit and 1 ng of oligonucleotide DPNCDN as primer. First- and second-strand synthesis were carried out as described in the Kit's user manual protocol (CLONTECH Protocol No. PT1117-1, Catalog No. K1804-1). The resulting cDNA was digested with Dpn II for 3 hrs at 37° C. Digested cDNA was extracted with phenol/chloroform (1:1) and ethanol precipitated.

Tester cDNA was generated by diluting 1 μl of Dpn II digested cDNA from the relevant tissue source (see above) (400 ng) in 5 μl of water. The diluted cDNA (2 μl, 160 ng) was then ligated to 2 μl of Adaptor 1 and Adaptor 2 (10 μM), in separate ligation reactions, in a total volume of 10 μl at 16° C. overnight, using 400 U of T4 DNA ligase (CLONTECH). Ligation was terminated with 1 μl of 0.2 M EDTA and heating at 72° C. for 5 min.

The first hybridization was performed by adding 1.5 μl (600 ng) of driver cDNA to each of two tubes containing 1.5 μl (20 ng) Adaptor 1- and Adaptor 2-ligated tester cDNA. In a final volume of 4 μl, the samples were overlaid with mineral oil, denatured in an MJ Research thermal cycler at 98° C. for 1.5 minutes, and then were allowed to hybridize for 8 hrs at 68° C. The two hybridizations were then mixed together with an additional 1 μl of fresh denatured driver cDNA and were allowed to hybridize overnight at 68° C. The second hybridization was then diluted in 200 μl of 20 mM Hepes, pH 8.3, 50 mM NaCl, 0.2 mM EDTA, heated at 70° C. for 7 min. and stored at −20° C.

PCR Amplification, Cloning and Sequencing of Gene Fragments Generated from SSH:

To amplify gene fragments resulting from SSH reactions, two PCR amplifications were performed. In the primary PCR reaction 1 μl of the diluted final hybridization mix was added to 1 μl of PCR primer 1 (10 μM), 0.5 μl dNTP mix (10 μM), 2.5 μl 10×reaction buffer (CLONTECH) and 0.5 μl 50×Advantage cDNA polymerase Mix (CLONTECH) in a final volume of 25 μl. PCR 1 was conducted using the following conditions: 75° C. for 5 min., 94° C. for 25 sec., then 27 cycles of 94° C. for 10 sec, 66° C. for 30 see, 72° C. for 1.5 min. Five separate primary PCR reactions were performed for each experiment. The products were pooled and diluted 1:10 with water. For the secondary PCR reaction, 1 μl from the pooled and diluted primary PCR reaction was added to the same reaction mix as used for PCR 1, except that primers NP1 and NP2 (10 μM) were used instead of PCR primer 1. PCR 2 was performed using 10-12 cycles of 94° C. for 10 sec, 68° C. for 30 sec, and 72° C. for 1.5 minutes. The PCR products were analyzed using 2% agarose gel electrophoresis.

The PCR products were inserted into pCR2.1 using the T/A vector cloning kit (Invitrogen). Transformed E. coli were subjected to blue/white and ampicillin selection. White colonies were picked and arrayed into 96 well plates and were grown in liquid culture overnight. To identify inserts, PCR amplification was performed on 1 ml of bacterial culture using the conditions of PCR1 and NP1 and NP2 as primers. PCR products were analyzed using 2% agarose gel electrophoresis.

Bacterial clones were stored in 20% glycerol in a 96 well format. Plasmid DNA was prepared, sequenced, and subjected to nucleic acid homology searches of the GenBank, dBest, and NCI-CGAP databases.

RT-PCR Expression Analysis:

First strand cDNAs can be generated from 1 μg of mRNA with oligo (dT)12-18 priming using the Gibco-BRL Superscript Preamplification system. The manufacturer's protocol was used which included an incubation for 50 min at 42° C. with reverse transcriptase followed by RNAse H treatment at 37° C. for 20 min. After completing the reaction, the volume can be increased to 200 μl with water prior to normalization. First strand cDNAs from 16 different normal human tissues can be obtained from Clontech.

Normalization of the first strand cDNAs from multiple tissues was performed by using the primers 5'atatcgccgcgctcgtcgtcgacaa3' (SEQ ID NO: 3003) and 5'agccacacgcagctcattgtagaagg 3' (SEQ ID NO: 3004) to amplify β-actin. First strand cDNA (5 μl) were amplified in a total volume of 50 μl containing 0.4 μM primers, 0.2 μM each dNTPs, 1×PCR buffer (Clontech, 10 mM Tris-HCL, 1.5 mM MgCl$_2$, 50 mM KCl, pH 8.3) and 1×Klentaq DNA polymerase (Clontech). Five μl of the PCR reaction can be removed at 18, 20, and 22 cycles and used for agarose gel electrophoresis. PCR was performed using an MJ Research thermal cycler under the following conditions: Initial denaturation can be at 94° C. for 15 sec, followed by a 18, 20, and 22 cycles of 94° C. for 15, 65° C. for 2 min, 72° C. for 5 sec. A final extension at 72° C. was carried out for 2 min. After agarose gel electrophoresis, the band intensities of the 283 bp β-actin bands from multiple tissues were compared by visual inspection. Dilution factors for the first strand cDNAs were calculated to result in equal β-actin band intensities in all tissues after 22 cycles of PCR. Three rounds of normalization can be required to achieve equal band intensities in all tissues after 22 cycles of PCR.

To determine expression levels of the 193P1E1B gene, 5 μl of normalized first strand cDNA were analyzed by PCR using 26, and 30 cycles of amplification. Semi-quantitative expression analysis can be achieved by comparing the PCR products at cycle numbers that give light band intensities.

A typical RT-PCR expression analysis is shown in FIG. 10. RT-PCR expression analysis was performed on first strand cDNAs generated using pools of tissues from multiple samples. The cDNAs were shown to be normalized using beta-actin PCR. Strong expression of 193P1E1B was observed in prostate cancer xenograft pool, bladder cancer pool, kidney cancer pool, colon cancer pool, lung cancer pool, ovary cancer pool, breast cancer pool, and metastasis pool. Low expression was observed in prostate cancer pool, but no expression was detected in VP1 and VP2.

Example 2

Full Length Cloning of 193P1E1B

To isolate genes that are involved in prostate cancer, an experiment was conducted using the prostate cancer xenograft LAPC-9AD$^2$. The gene 193P1E1B was derived from a subtraction consisting of a prostate cancer xenograft LAPC-9AD$_2$ minus prostate cancer xenograft LAPC-9AD. The SSH DNA sequence (FIG. 1) was designated 193P1E1B SSH. 193P1E1B variants were identified (FIGS. 2, 3 and 19). cDNA clone 193P1E1B v.1 and 193P1E1B v.2 were cloned from bladder cancer pool cDNA; cDNA clone 193P1E1B v.3 was cloned from LAPC-4AD cDNA library.

Protein sequence alignment of 193P1E1B v.1 and 193P1E1B v.2, and of 193P1E1B v.1 and 193P1E1B v.3 are shown in FIGS. 4A and 4B respectively. A single base pair variation was identified with a G instead of an A at nucleotide position 1253 of 193P1E1B v.2, when compared to 193P1E1B v.1. This nucleotide change converted amino acid position 150 from glutamic acid in the 193P1E1B v.1 protein sequence, to glycine in 193P1E1B v.2. Absence of a 62-nucleotide sequence was identified in 193P1E1B v.3, a sequence that was present in 193P1E1B v.1 and 193P1E1B v.2 (positions 907-969). This resulted in an 82-amino acid truncation at the amino terminus of 193P1E1B v.3. Also, 193P1E1B v.3 contained one nucleotide substitution at position 698, thereby coding for alanine at amino acid position 172 of 193P1E1B v.3, instead of threonine at amino acid position 254 of 193P1E1B v.1 and v.2.

Example 3

Chromosomal Localization

Chromosomal localization can implicate genes in disease pathogenesis. Several chromosome mapping approaches are available, including fluorescent in situ hybridization (FISH), human/hamster radiation hybrid (RH) panels (Walter et al., 1994; Nature Genetics 7:22; Research Genetics, Huntsville Al), human-rodent somatic cell hybrid panels such as is available from the Coriell Institute (Camden, N.J.), and genomic viewers utilizing BLAST homologies to sequenced and mapped genomic clones (NCBI, Bethesda, Md.).

193P1E1B maps to chromosome 13q11, using 193P1E1B sequence and the NCBI BLAST tool. This 13q11 region has been previously implicated in bladder cancer (Wada T, Louhelainen J, Hemminki K, Adolfsson J, Wijkstrom H, Norming U, Borgstrom E, Hansson J, Sandstedt B, Steineck G. Bladder cancer: allelic deletions at and around the retinoblastoma tumor suppressor gene relation to stage and grade. Clin Cancer Res. 2000 February; 6(2):610-5.).

Example 4

Expression Analysis of 193P1E1B in Normal Tissues and Patient Specimens

Expression of 193P1E1B was analyzed using the two sets of primers as illustrated in FIG. 10A. First strand cDNA was prepared from vital pool 1 (VP1: liver, lung and kidney), vital pool 2 (VP2, pancreas, colon and stomach), prostate xenograft pool (LAPC-4AD, LAPC-4AI, LAPC-9AD, LAPC-9AI), normal thymus, prostate cancer pool, bladder cancer pool, kidney cancer pool, colon cancer pool, lung cancer pool, ovary cancer pool, breast cancer pool, metastasis cancer pool, pancreas cancer pool, and from prostate cancer metastasis to lymph node from two different patients. Normalization was performed by PCR using primers to actin and GAPDH. Semi-quantitative PCR, using Primer Set A (FIG. 10B) or Primer Set B (FIG. 10C) to 193P1E1B, was performed at 30 cycles of amplification, FIG. 10C also provides data at 26 cycles. A schematic diagram depicting the location of the two primer sets A and B is shown in FIG. 10A. Primer Set A detected a PCR product of 190 bp which is identical in all three variants of 193P1E1B (FIG. 10B). Primer Set B detected a PCR product of 239 bp from 193P1E1B v.1 and 193P1E1B v.2, and of 177 bp from 193P1E1B v.3 (FIG. 5C). Expression of 193P1E1B was observed in prostate cancer xenograft pool, prostate cancer pool, bladder cancer pool, kidney cancer pool, colon cancer pool, lung cancer pool, ovary cancer pool, breast cancer pool, metastasis cancer pool, pancreas cancer pool, as well as the two prostate metastasis to lymph node, but not in VP1 and VP2 (FIG. 10B).

In order to test extent of expression of 193P1E1B v.1 and 193P1E1B v.2 compared to 193P1E1B v.3, an experiment was conducted in which RT-PCR was performed using Primer Set B (FIG. 10C).

Results showed that relative expression of 193P1E1B v.1 and 193P1E1B v.2 compared to 193P1E1B v.3 is similar in all tissues found to express 193P1E1B.

Extensive Northern blot analysis of 193P1E1B in 16 human normal tissues confirmed the expression observed by RT-PCR (FIG. 11). Two transcripts of approximately 3.5 kb and 2 kb are only detected in testis and thymus, but not in any other normal tissue tested.

FIG. 12 shows expression of 193P1E1B in prostate cancer xenografts. RNA was extracted from normal prostate, and from prostate cancer xenografts, LAPC-4AD, LAPC-4AI, LAPC-9AD, and LAPC-9AI. Northern blot with 10 µg of total RNA/lane was probed with 193P1E1B SSH sequence. Northern blot analysis shows expression of 193P1E1B in all four tissues, LAPC-4AD, LAPC-4AI, LAPC-9AD, LAPC-9AI, with the lowest expression detected in the LAPC-9AD tissue, but not in normal prostate.

To test expression of 193P1E1B in patient cancer specimens, RNA was extracted from a pool of three patients for each of the following, bladder cancer, colon cancer, ovary cancer and metastasis cancer, as well as from normal prostate (NP), normal bladder (NB), normal kidney (NK), normal colon (NC). Northern blots with 10 µg of total RNA/lane were probed with 193P1E1B SSH sequence (FIG. 13). Results showed expression of 193P1E1B in bladder cancer pool, colon cancer pool, ovary cancer pool and metastasis cancer pool, but not in any of the normal tissues tested.

Analysis of individual bladder cancer tissues by Northern blot shows expression of 193P1 µl B in the two bladder cancer cell lines and in the three bladder cancer patient specimens tested, but not in normal bladder tissues (FIG. 14).

FIG. 15 shows expression of 193P1E1B in cancer metastasis patient specimens. RNA was extracted from the following cancer metastasis tissues, colon metastasis to lung, lung metastasis to lymph node, lung metastasis to skin, and breast metastasis to lymph node, as well as from normal bladder (NB), normal lung (NL), normal breast (NBr), and normal ovary (NO). Northern blots with 10 µg of total RNA/lane were probed with 193P1E1B sequence. Size standards in kilobases (kb) are indicated on the side.) The results show expression of 193P1E1B in all four different cancer metastasis samples but not in the normal tissues tested.

FIG. 16 shows expression of 193P1E1B in pancreatic, ovarian and testicular cancer patient specimens. RNA was extracted from pancreatic cancer (P1), ovarian cancer (P2, P3), and testicular cancer (P4, P5) isolated from cancer patients, as well as from normal pancreas (NPa). Northern blots with 10 µg of total RNA/lane were probed with 193P1E1B sequence. Size standards in kilobases (kb) are indicated on the side. The results show expression of 193P1E1B in pancreatic, ovarian and testicular cancer specimens but not in normal pancreas.

193P1E1B expression is reminiscent of a cancer-testis gene. Its restricted normal tissue expression and the upregulation detected in prostate cancer, bladder cancer, kidney cancer, colon cancer, lung cancer, ovary cancer, breast cancer and pancreatic cancer indicate that 193P1E1B is therapeutic and prophylactic target and a diagnostic and prognostic marker for human cancers.

Example 5

Production of Recombinant 193P1E1B in Prokaryotic Systems

To express recombinant 193P1E1B in prokaryotic cells, the full or partial length 193P1E1B cDNA sequences can be cloned into any one of a variety of expression vectors known in the art. One or more of the following regions of 193P1E1B are expressed in these constructs, amino acids 1 to 412 of variant 1 or variant 2; or amino acids 1 to 388 of variant 4, or any 8, 9, 10, 11, 12, 13, 14, 15, 16, 17, 18, 19, 20, 21, 22, 23, 24, 25, 26, 27, 28, 29, 30 or more contiguous amino acids from 193P1E1B, variants, or analogs thereof. In certain embodiments a region of 193P1E1B is expressed that encodes an amino acid not shared amongst at least variants.

A. In Vitro Transcription and Translation Constructs:

pCRII: To generate 193P1E1B sense and anti-sense RNA probes for RNA in situ investigations, pCRII constructs (Invitrogen, Carlsbad Calif.) are generated encoding either all or fragments of a 193P1E1B cDNA. The pCRII vector has Sp6 and T7 promoters flanking the insert to drive the transcription of 193P1E1B RNA for use as probes in RNA in situ hybridization experiments. These probes are used to analyze the cell and tissue expression of 193P1E1B at the RNA level. Transcribed 193P1E1B RNA representing the cDNA amino acid coding region of the 193P1E1B gene is used in in vitro translation systems such as the TnT™ Coupled Reticulolysate System (Promega, Corp., Madison, Wis.) to synthesize 193P1E1B protein.

B. Bacterial Constructs:

pGEX Constructs: To generate recombinant 193P1E1B proteins in bacteria that are fused to the Glutathione S-transferase (GST) protein, all or parts of a 193P1E1B cDNA protein coding sequence are fused to the GST gene by cloning into pGEX-6P-1 or any other GST-fusion vector of the pGEX family (Amersham Pharmacia Biotech, Piscataway, N.J.). These constructs allow controlled expression of recombinant 193P1E1B protein sequences with GST fused at the amino-terminus and a six histidine epitope (6×His) (SEQ ID NO: 2990) at the carboxyl-terminus. The GST and 6×His (SEQ ID NO: 2990) tags permit purification of the recombinant fusion protein from induced bacteria with the appropriate affinity matrix and allow recognition of the fusion protein with anti-GST and anti-His antibodies. The 6×His (SEQ ID NO: 2990) tag is generated by adding 6 histidine codons to the cloning primer at the 3' end, e.g., of the open reading frame (ORF). A proteolytic cleavage site, such as the PreScission™ recognition site in pGEX-6P-1, may be employed such that it permits cleavage of the GST tag from 193P1E1B-related protein. The ampicillin resistance gene and pBR322 origin permits selection and maintenance of the pGEX plasmids in E. coli.

pMAL Constructs: To generate, in bacteria, recombinant 193P1E1B proteins that are fused to maltose-binding protein (MBP), all or parts of a 193P1E1B cDNA protein coding sequence are fused to the MBP gene by cloning into the pMAL-c2X and pMAL-p2X vectors (New England Biolabs, Beverly, Mass.). These constructs allow controlled expression of recombinant 193P1E1B protein sequences with MBP fused at the amino-terminus and a 6×His (SEQ ID NO: 2990) epitope tag at the carboxyl-terminus. The MBP and 6×His (SEQ ID NO: 2990) tags permit purification of the recombinant protein from induced bacteria with the appropriate affinity matrix and allow recognition of the fusion protein with anti-MBP and anti-His antibodies. The 6×His (SEQ ID NO: 2990) epitope tag is generated by adding 6 histidine codons to the 3' cloning primer. A Factor Xa recognition site permits cleavage of the pMAL tag from 193P1E1B. The pMAL-c2X and pMAL-p2X vectors are optimized to express the recombinant protein in the cytoplasm or periplasm respectively. Periplasm expression enhances folding of proteins with disulfide bonds.

pET Constructs: To express 193P1E1B in bacterial cells, all or parts of a 193P1E1B cDNA protein coding sequence are cloned into the pET family of vectors (Novagen, Madison, Wis.). These vectors allow tightly controlled expression of recombinant 193P1E1B protein in bacteria with and without fusion to proteins that enhance solubility, such as NusA and thioredoxin (Trx), and epitope tags, such as 6×His (SEQ ID NO: 2990) and S-Tag™ that aid purification and detection of the recombinant protein. For example, constructs are made utilizing pET NusA fusion system 43.1 such that regions of a 193P1E1B protein are expressed as amino-terminal fusions to NusA.

C. Yeast Constructs:

pESC Constructs: To express 193P1E1B in the yeast species Saccharomyces cerevisiae for generation of recombinant protein and functional studies, all or parts of a 193P1E1B cDNA protein coding sequence are cloned into the pESC family of vectors each of which contain 1 of 4 selectable markers, HIS3, TRP1, LEU2, and URA3 (Stratagene, La Jolla, Calif.). These vectors allow controlled expression from the same plasmid of up to 2 different genes or cloned sequences containing either Flag™ or Myc epitope tags in the same yeast cell. This system is useful to confirm protein-protein interactions of 193P1E1B. In addition, expression in yeast yields similar post-translational modifications, such as glycosylations and phosphorylations, that are found when expressed in eukaryotic cells.

pESP Constructs: To express 193P1E1B in the yeast species Saccharomyces pombe, all or parts of a 193P1E1B cDNA protein coding sequence are cloned into the pESP family of vectors. These vectors allow controlled high level of expression of a 193P1E1B protein sequence that is fused at either the amino terminus or at the carboxyl terminus to GST which aids purification of the recombinant protein. A Flag™ epitope tag allows detection of the recombinant protein with anti-Flag™ antibody.

Example 6

Production of Recombinant 193P1E1B in Eukaryotic Systems

A. Mammalian Constructs:

To express recombinant 193P1E1B in eukaryotic cells, the full or partial length 193P1E1B cDNA sequences can be cloned into any one of a variety of expression vectors known in the art. One or more of the following regions of 193P1E1B are expressed in these constructs, amino acids 1 to 412 of variant 1 or variant 2; or amino acids 1 to 388 of variant 4, or any 8, 9, 10, 11, 12, 13, 14, 15, 16, 17, 18, 19, 20, 21, 22, 23, 24, 25, 26, 27, 28, 29, 30 or more contiguous amino acids from 193P1E1B, variants, or analogs thereof. In certain embodiments a region of 193P1E1B is expressed that encodes an amino acid not shared amongst at least variants.

The constructs can be transfected into any one of a wide variety of mammalian cells such as 293T cells. Transfected 293T cell lysates can be probed with the anti-193P1E1B polyclonal serum, described herein.

pcDNA4/HisMax Constructs: To express 193P1E1B in mammalian cells, a 193P1E1B ORF, or portions thereof, of 193P1E1B are cloned into pcDNA4/HisMax Version A (Invitrogen, Carlsbad, Calif.). Protein expression is driven from the cytomegalovirus (CMV) promoter and the SP16 translational enhancer. The recombinant protein has Xpress™ and six histidine (6×His) (SEQ ID NO: 2990) epitopes fused to the amino-terminus. The pcDNA4/HisMax vector also contains the bovine growth hormone (BGH) polyadenylation signal and transcription termination sequence to enhance mRNA stability along with the SV40 origin for episomal replication and simple vector rescue in cell lines expressing the large T antigen. The Zeocin resistance gene allows for selection of mammalian cells expressing the protein and the ampicillin resistance gene and ColE1 origin permits selection and maintenance of the plasmid in *E. coli*.

pcDNA3.1/MycHis Constructs: To express 193P1E1B in mammalian cells, a 193P1E1B ORF, or portions thereof, of 193P1E1B with a consensus Kozak translation initiation site are cloned into pcDNA3.1MycHis Version A (Invitrogen, Carlsbad, Calif.). Protein expression is driven from the cytomegalovirus (CMV) promoter. The recombinant proteins have the myc epitope and 6×His (SEQ ID NO: 2990) epitope fused to the carboxyl-terminus. The pcDNA3.1/MycHis vector also contains the bovine growth hormone (BGH) polyadenylation signal and transcription termination sequence to enhance mRNA stability, along with the SV40 origin for episomal replication and simple vector rescue in cell lines expressing the large T antigen. The Neomycin resistance gene can be used, as it allows for selection of mammalian cells expressing the protein and the ampicillin resistance gene and ColE1 origin permits selection and maintenance of the plasmid in *E. coli*.

PcDNA3.1/CT-GFP-TOPO Construct: To express 193P1E1B in mammalian cells and to allow detection of the recombinant proteins using fluorescence, a 193P1E1B ORF, or portions thereof, with a consensus Kozak translation initiation site are cloned into pcDNA3.1/CT-GFP-TOPO (Invitrogen, CA). Protein expression is driven from the cytomegalovirus (CMV) promoter. The recombinant proteins have the Green Fluorescent Protein (GFP) fused to the carboxyl-terminus facilitating non-invasive, in vivo detection and cell biology studies. The pcDNA3.1CT-GFP-TOPO vector also contains the bovine growth hormone (BGH) polyadenylation signal and transcription termination sequence to enhance mRNA stability along with the SV40 origin for episomal replication and simple vector rescue in cell lines expressing the large T antigen. The Neomycin resistance gene allows for selection of mammalian cells that express the protein, and the ampicillin resistance gene and ColE1 origin permits selection and maintenance of the plasmid in *E. coli*. Additional constructs with an amino-terminal GFP fusion are made in pcDNA3.1/NT-GFP-TOPO spanning the entire length of a 193P1E1B protein.

PAPtag: A 193P1E1B ORF, or portions thereof, is cloned into pAPtag-5 (GenHunter Corp. Nashville, Tenn.). This construct generates an alkaline phosphatase fusion at the carboxyl-terminus of a 193P1E1B protein while fusing the IgGκ signal sequence to the amino-terminus. Constructs are also generated in which alkaline phosphatase with an amino-terminal IgGκ signal sequence is fused to the amino-terminus of a 193P1E1B protein. The resulting recombinant 193P1E1B proteins are optimized for secretion into the media of transfected mammalian cells and can be used to identify proteins such as ligands or receptors that interact with 193P1E1B proteins. Protein expression is driven from the CMV promoter and the recombinant proteins also contain myc and 6×His (SEQ ID NO: 2990) epitopes fused at the carboxyl-terminus that facilitates detection and purification. The Zeocin resistance gene present in the vector allows for selection of mammalian cells expressing the recombinant protein and the ampicillin resistance gene permits selection of the plasmid in *E. coli*.

ptag5: A 193P1E1B ORF, or portions thereof, is cloned into pTag-5. This vector is similar to pAPtag but without the alkaline phosphatase fusion. This construct generates 193P1E1B protein with an amino-terminal IgGκ signal sequence and myc and 6×His (SEQ ID NO: 2990) epitope tags at the carboxyl-terminus that facilitate detection and affinity purification. The resulting recombinant 193P1E1B protein is optimized for secretion into the media of transfected mammalian cells, and is used as immunogen or ligand to identify proteins such as ligands or receptors that interact with the 193P1E1B proteins. Protein expression is driven from the CMV promoter. The Zeocin resistance gene present in the vector allows for selection of mammalian cells expressing the protein, and the ampicillin resistance gene permits selection of the plasmid in *E. coli*.

PsecFc: A 193P1E1B ORF, or portions thereof, is also cloned into psecFc. The psecFc vector was assembled by cloning the human immunoglobulin G1 (IgG) Fc (hinge, CH2, CH3 regions) into pSecTag2 (Invitrogen, California). This construct generates an IgG1 Fc fusion at the carboxyl-terminus of the 193P1E1B proteins, while fusing the IgGκ signal sequence to N-terminus. 193P1E1B fusions utilizing the murine IgG1 Fc region are also used. The resulting recombinant 193P1E1B proteins are optimized for secretion into the media of transfected mammalian cells, and can be used as immunogens or to identify proteins such as ligands or receptors that interact with 193P1E1B protein. Protein expression is driven from the CMV promoter. The hygromycin resistance gene present in the vector allows for selection of mammalian cells that express the recombinant protein, and the ampicillin resistance gene permits selection of the plasmid in *E. coli*.

pSRα Constructs: To generate mammalian cell lines that express 193P1E1B constitutively, 193P1E1B ORF, or portions thereof, of 193P1E1B are cloned into pSRα constructs. Amphotropic and ecotropic retroviruses are generated by transfection of pSRα constructs into the 293T-10A1 packaging line or co-transfection of pSRα and a helper plasmid (containing deleted packaging sequences) into the 293 cells, respectively. The retrovirus is used to infect a variety of mammalian cell lines, resulting in the integration of the cloned gene, 193P1E1B, into the host cell-lines. Protein expression is driven from a long terminal repeat (LTR). The Neomycin resistance gene present in the vector allows for selection of mammalian cells that express the protein, and the ampicillin resistance gene and ColE1 origin permit selection and maintenance of the plasmid in *E. coli*. The retroviral vectors can thereafter be used for infection and generation of various cell lines using, for example, PC3, NIH 3T3, TsuPr1, 293 or rat-I cells.

Additional pSRα constructs are made that fuse an epitope tag such as the FLAG™ tag to the carboxyl-terminus of 193P1E1B sequences to allow detection using anti-Flag antibodies. For example, the FLAG™ sequence 5' gat tac aag gat gac gac gat aag 3' (SEQ ID NO: 3005) is added to cloning primer at the 3' end of the ORF. Additional pSRα constructs are made to produce both amino-terminal and carboxyl-terminal GFP and myc/6×His (SEQ ID NO: 2990) fusion proteins of the full-length 193P1E1B proteins.

Additional Viral Vectors: Additional constructs are made for viral-mediated delivery and expression of 193P1E1B. High virus titer leading to high level expression of 193P1E1B is achieved in viral delivery systems such as adenoviral vectors and herpes amplicon vectors. A 193P1E1B coding sequences or fragments thereof are amplified by PCR and subcloned into the AdEasy shuttle vector (Stratagene). Recombination and virus packaging are performed according to the manufacturer's instructions to generate adenoviral vectors. Alternatively, 193P1E1B coding sequences or fragments thereof are cloned into the HSV-1 vector (Imgenex) to generate herpes viral vectors. The viral vectors are thereafter used for infection of various cell lines such as PC3, NIH 3T3, 293 orrat-1 cells.

Regulated Expression Systems: To control expression of 193P1E1B in mammalian cells, coding sequences of 193P1E1B, or portions thereof, are cloned into regulated mammalian expression systems such as the T-Rex System (Invitrogen), the GeneSwitch System (Invitrogen) and the tightly-regulated Ecdysone System (Sratagene). These systems allow the study of the temporal and concentration dependent effects of recombinant 193P1E1B. These vectors are thereafter used to control expression of 193P1E1B in various cell lines such as PC3, NIH 3T3, 293 or rat-1 cells.

B. Baculovirus Expression Systems

To generate recombinant 193P1E1B proteins in a baculovirus expression system, 193P1E1B ORF, or portions thereof, are cloned into the baculovirus transfer vector pBlueBac 4.5 (Invitrogen), which provides a His-tag at the N-terminus. Specifically, pBlueBac-193P1E1B is co-transfected with helper plasmid pBac-N-Blue (Invitrogen) into SF9 (*Spodoptera frugiperda*) insect cells to generate recombinant baculovirus (see Invitrogen instruction manual for details). Baculovirus is then collected from cell supernatant and purified by plaque assay.

Recombinant 193P1E1B protein is then generated by infection of HighFive insect cells (Invitrogen) with purified baculovirus. Recombinant 193P1E1B protein can be detected using anti-193P1E1B or anti-His-tag antibody. 193P1E1B protein can be purified and used in various cell-based assays or as immunogen to generate polyclonal and monoclonal antibodies specific for 193P1E1B.

Example 7

Antigenicity Profiles and Secondary Structure

FIG. 5, FIG. 6, FIG. 7, FIG. 8, and FIG. 9 depict graphically five amino acid profiles of the 193P1E1B amino acid sequence (variant 1), each assessment is available by accessing the ProtScale website on the ExPasy molecular biology server.

These profiles: FIG. 5, Hydrophilicity, (Hopp T. P., Woods K. R., 1981. Proc. Natl. Acad. Sci. U.S.A. 78:3824-3828); FIG. 6, Hydropathicity, (Kyte J., Doolittle R. F., 1982. J. Mol. Biol. 157:105-132); FIG. 7, Percentage Accessible Residues (Janin J., 1979 Nature 277:491-492); FIG. 8, Average Flexibility, (Bhaskaran R., and Ponnuswamy P. K., 1988. Int. J. Pept. Protein Res. 32:242-255); FIG. 9, Beta-turn (Deleage, G., Roux B. 1987 Protein Engineering 1:289-294); and optionally others available in the art, such as on the ProtScale website, were used to identify antigenic regions of 193P1E1B protein. Each of the above amino acid profiles of 193P1E1B were generated using the following ProtScale parameters for analysis: 1) A window size of 9; 2) 100% weight of the window edges compared to the window center; and, 3) amino acid profile values normalized to lie between 0 and 1.

Hydrophilicity (FIG. 5), Hydropathicity (FIG. 6) and Percentage Accessible Residues (FIG. 7) profiles were used to determine stretches of hydrophilic amino acids (i.e., values greater than 0.5 on the Hydrophilicity and Percentage Accessible Residues profiles, and values less than 0.5 on the Hydropathicity profile). Such regions are likely to be exposed to the aqueous environment, be present on the surface of the protein, and thus available for immune recognition, such as by antibodies.

Average Flexibility (FIG. 8) and Beta-turn (FIG. 9) profiles determine stretches of amino acids (i.e., values greater than 0.5 on the Beta-turn profile and the Average Flexibility profile) that are not constrained in secondary structures such as beta sheets and alpha helices. Such regions are also more likely to be exposed on the protein and thus accessible to immune recognition, such as by antibodies.

Antigenic sequences of the full length 193P1E1B protein (variant 1) indicated, e.g., by the profiles set forth in FIG. 5, FIG. 6, FIG. 7, FIG. 8, and/or FIG. 9 are used to prepare immunogens, either peptides or nucleic acids that encode them, to generate therapeutic and diagnostic anti-193P1E1B antibodies. The immunogen can be any 5, 6, 7, 8, 9, 10, 11, 12, 13, 14, 15, 16, 17, 18, 19, 20, 21, 22, 23, 24, 25, 30, 35, 40, 45, 50 or more than 50 contiguous amino acids, or the corresponding nucleic acids that encode them, from 193P1E1B protein. In particular, peptide immunogens of the invention can comprise, a peptide region of at least 5 amino acids of FIG. 2 in any whole number increment up to 412 that includes an amino acid position having a value greater than 0.5 in the Hydrophilicity profile of FIG. 5; a peptide region of at least 5 amino acids of FIG. 2 in any whole number increment up to 412 that includes an amino acid position having a value less than 0.5 in the Hydropathicity profile of FIG. 6; a peptide region of at least 5 amino acids of FIG. 2 in any whole number increment up to 412 that includes an amino acid position having a value greater than 0.5 in the Percent Accessible Residues profile of FIG. 7; a peptide region of at least 5 amino acids of FIG. 2 in any whole number increment up to 412 that includes an amino acid position having a value greater than 0.5 in the Average Flexibility profile on FIG. 8; and, a peptide region of at least 5 amino acids of FIG. 2 in any whole number increment up to 412 that includes an amino acid position having a value greater than 0.5 in the Beta-turn profile of FIG. 9. Peptide immunogens of the invention can also comprise nucleic acids that encode any of the forgoing.

All immunogens of the invention, peptide or nucleic acid, can be embodied in human unit dose form, or comprised by a composition that includes a pharmaceutical excipient compatible with human physiology.

The secondary structure of 193P1E1B, namely the predicted presence and location of alpha helices, extended strands, and random coils, is predicted from the primary amino acid sequence of 193P1E1B variant 1 using the HNN—Hierarchical Neural Network method (Guermeur, 1997), accessed from the ExPasy molecular biology server. The analysis indicates that 193P1E1B is composed 29.13% alpha helix, 9.95% extended strand, and 60.92% random coil (FIG. 17).

Analysis of 193P1E1B using a variety of transmembrane prediction algorithms accessed from the ExPasy molecular biology server did not predict the presence of such domains, confirming that 193P1E1B is a soluble protein.

Example 8

Generation of 193P1E1B Polyclonal Antibodies

Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. In addition to immunizing with the full length 193P1E1B protein, computer algorithms are employed in design of immunogens that, based on amino acid sequence analysis contain characteristics of being antigenic and available for recognition by the immune system of the immunized host (see the Example entitled "Antigenicity Profiles and Secondary Structure"). Such regions would be predicted to be hydrophilic, flexible, in beta-turn conformations, and be exposed on the surface of the protein (see, e.g., FIG. 5, FIG. 6, FIG. 7, FIG. 8, or FIG. 9 for amino acid profiles that indicate such regions of 193P1E1B).

For example, 193P1E1B recombinant bacterial fusion proteins or peptides containing hydrophilic, flexible, beta-turn regions of 193P1E1B are used as antigens to generate polyclonal antibodies in New Zealand White rabbits. For example, such regions include, but are not limited to, amino acids 20-43, amino acids 100-164, amino acids 241-261, or amino acids 310-331. It is useful to conjugate the immunizing agent to a protein known to be immunogenic in the mammal being immunized. Examples of such immunogenic proteins include, but are not limited to, keyhole limpet hemocyanin (KLH), serum albumin, bovine thyroglobulin, and soybean trypsin inhibitor. In one embodiment, a peptide encoding amino'acids 241-261 of 193P1E1B is conjugated to KLH and used to immunize the rabbit. Alternatively the immunizing agent may include all or portions of a 193P1E1B protein, analogs or fusion proteins thereof.

For example, a 193P1E1B amino acid sequence can be fused using recombinant DNA techniques to any one of a variety of fusion protein partners that are well known in the art, such as glutathione-S-transferase (GST) and HIS tagged fusion proteins. Such fusion proteins are purified from induced bacteria using the appropriate affinity matrix.

In one embodiment, a GST-fusion protein containing an entire 193P1E1B coding sequence is produced and purified and used as immunogen. Other recombinant bacterial fusion proteins that can be employed include maltose binding protein, LacZ, thioredoxin, NusA, or an immunoglobulin constant region (see the section entitled "Production of 193P1E1B in Prokaryotic Systems" and Current Protocols In Molecular Biology, Volume 2, Unit 16, Frederick M. Ausubul et al. eds., 1995; Linsley, P. S., Brady, W., Umes, M., Grosmaire, L., Damile, N., and Ledbetter, L.(1991) J. Exp. Med. 174, 561-566).

In addition to bacterial-derived fusion proteins, mammalian-expressed protein antigens are also used. These antigens are expressed from mammalian expression vectors such as the Tag5 and Fc-fusion vectors (see the section entitled "Production of Recombinant 193P1E1B in Eukaryotic Systems"), and retain post-translational modifications such as glycosylations found in native protein. In one embodiment, an entire 193P1E1B coding sequence is cloned into the Tag5 mammalian secretion vector. The recombinant protein is purified by metal chelate chromatography from tissue culture supernatants of 293T cells stably expressing the recombinant vector. The purified Tag5 193P1E1B protein is then used as immunogen.

During the immunization protocol, it is useful to mix or emulsify the antigen in adjuvants that enhance the immune response of the host animal. Examples of adjuvants include, but are not limited to, complete Freund's adjuvant (CFA) and MPL-TDM adjuvant (monophosphoryl Lipid A, synthetic trehalose dicorynomycolate).

In a typical protocol, rabbits are initially immunized subcutaneously with up to 200 µg, typically 100-200 µg, of fusion protein or peptide conjugated to KLH mixed in complete Freund's adjuvant (CFA). Rabbits are then injected subcutaneously every two weeks with up to 200 µg, typically 100-200 µg, of the immunogen in incomplete Freund's adjuvant (IFA). Test bleeds are taken approximately 7-10 days following each immunization and used to monitor the titer of the antiserum by ELISA.

To test reactivity and specificity of immune serum, such as the rabbit serum derived from immunization with Tag5 193P1E1B protein or KLH-coupled peptide encoding amino acids 241-261, the full-length 193P1E1B cDNA is cloned into pcDNA 3.1 myc-his expression vector (Invitrogen, see the Example entitled "Production of Recombinant 193P1E1B in Eukaryotic Systems"). After transfection of the constructs into 293T cells, cell lysates are probed with the anti-193P1E1B serum and with anti-His antibody (Santa Cruz Biotechnologies, Santa Cruz, Calif.) to determine specific reactivity to denatured 193P1E1B protein using the Western blot technique. Immunoprecipitation and flow cytometric analyses of 293T and other recombinant 193P1E1B-expressing cells determine recognition of native protein by the antiserum. In addition, Western blot, immunoprecipitation, fluorescent microscopy, and flow cytometric techniques using cells that endogenously express 193P1E1B are carried out to test specificity.

The anti-serum from the Tag5 193P1E1B immunized rabbit is affinity purified by passage over a column composed of the Tag5 antigen covalently coupled to Affigel matrix (Bio-Rad, Hercules, Calif.). The serum is then further purified by protein G affinity chromatography to isolate the IgG fraction. Serum from rabbits immunized with fusion proteins, such as GST and MBP fusion proteins, are purified by depletion of antibodies reactive to the fusion partner sequence by passage over an affinity column containing the fusion partner either alone or in the context of an irrelevant fusion protein. Sera from other His-tagged antigens and peptide immunized rabbits as well as fusion partner depleted sera are affinity purified by passage over a column matrix composed of the original protein immunogen or free peptide.

Example 9

Generation of 193P1E1B Monoclonal Antibodies (mAbs)

In one embodiment, therapeutic mAbs to 193P1E1B comprise those that react with epitopes of the protein that would disrupt or modulate the biological function of 193P1E1B, for example those that would disrupt its interaction with ligands, proteins, or substrates that mediate its biological activity. Immunogens for generation of such mAbs include those designed to encode or contain an entire 193P1E1B protein or its variants or regions of a193P1E1B protein predicted to be antigenic from computer analysis of the amino acid sequence (see, e.g., FIG. 5, FIG. 6, FIG. 7, FIG. 8, or FIG. 9, and the Example entitled "Antigenicity Profiles and Secondary Structure"). Immunogens include peptides, recombinant bacterial proteins, and mammalian expressed Tag 5 proteins and human and murine IgG FC fusion proteins. In addition, cells expressing high levels of 193P1E1B, such as 293T-193P1E1B or 300.19-193P1E1B murine Pre-B cells, are used to immunize mice.

To generate mAbs to 193P1E1B, mice are first immunized intraperitoneally (IP) with, typically, 10-50 µg of protein immunogen or $10^7$ 193P1E1B-expressing cells mixed in complete Freund's adjuvant. Mice are then subsequently immunized IP every 2-4 weeks with, typically, 10-50 µg of protein immunogen or $10^7$ cells mixed in incomplete Freund's adjuvant. Alternatively, MPL-TDM adjuvant is used in immunizations. In addition to the above protein and cell-based immunization strategies, a DNA-based immunization protocol is employed in which a mammalian expression vector encoding 193P1E1B sequence is used to immunize mice by direct injection of the plasmid DNA. For example, an entire coding sequence of 193P1E1B, e.g., amino acids 1-412 of 193P1E1B variant 1, is cloned into the Tag5 mammalian secretion vector and the recombinant vector is used as immunogen. In another example the amino acids are cloned into an Fc-fusion secretion vector in which a 193P1E1B sequence is fused at the amino-terminus to an IgK leader sequence and at the carboxyl-terminus to the coding sequence of the human or murine IgG Fc region. This recombinant vector is then used as immunogen. The plasmid immunization protocols are used in combination with purified proteins expressed from the same vector and with cells expressing 193P1E1B.

During the immunization protocol, test bleeds are taken 7-10 days following an injection to monitor titer and specificity of the immune response. Once appropriate reactivity and specificity is obtained as determined by ELISA, Western blotting, immunoprecipitation, fluorescence microscopy, and flow cytometric analyses, fusion and hybridoma generation is then carried out with established procedures well known in the art (see, e.g., Harlow and Lane, 1988).

In one embodiment, monoclonal antibodies are derived that distinguish between, e.g., the various 193P1E1B variants, e.g., the amino terminal truncated splice variant 3, encoding amino acids 83-412 and the full length protein encoding amino acids 1-412. In one method, two different Fc-fusion proteins are derived, one encoding amino acids 1-82, and the other encoding amino acids 83-412. These are expressed and purified from stably transfected 293T cells. Balb C mice are initially immunized intraperitoneally with 25 µg of the Tag5-193P1E1B protein mixed in complete Freund's adjuvant. Mice are subsequently immunized every two weeks with 25 µg of the antigen mixed in incomplete Freund's adjuvant for a total of three immunizations. ELISA using the Tag5 antigen determines the titer of serum from immunized mice. Reactivity and specificity of serum to the full length 193P1E1B protein and to amino terminal truncated variant 3 is monitored by Western blotting, immunoprecipitation and flow cytometry using 293T cells transfected with an expression vector encoding each of the respective 193P1E1B cDNAs (see e.g., the Example entitled "Production of Recombinant 193P1E1B in Eukaryotic Systems"). Other recombinant 193P1E1B-expressing cells or cells endogenously expressing 193P1E1B are also used. Mice showing the strongest reactivity are rested and given a final injection of Tag5 antigen in PBS and then sacrificed four days later. The spleens of the sacrificed mice are harvested and fused to SPO/2 myeloma cells using standard procedures (see, e.g., Harlow and Lane, 1988). Supernatants from HAT selected growth wells are screened by ELISA, Western blot, immunoprecipitation, fluorescent microscopy, and flow cytometry to identify 193P1E1B specific antibody-producing clones.

The binding affinity of a 193P1E1B monoclonal antibody is determined using standard technologies. Affinity measurements quantify the strength of antibody to epitope binding and are used to help define which 193P1E1B monoclonal antibodies preferred, e.g., for diagnostic or therapeutic use, as appreciated by one of skill in the art.

The BIAcore system (Uppsala, Sweden) is a preferred method for determining binding affinity. The BIAcore system uses surface plasmon resonance (SPR, Welford K. 1991, Opt. Quant. Elect. 23:1; Morton and Myszka, 1998, Methods in Enzymology 295: 268) to, monitor biomolecular interactions in real time. BIAcore analysis conveniently generates association rate constants, dissociation rate constants, equilibrium dissociation constants, and affinity constants.

Example 10

HLA Class I and Class II Binding Assays

HLA class I and class II binding assays using purified HLA molecules are performed in accordance with disclosed protocols (e.g., PCT publications WO 94/20127 and WO 94/03205; Sidney et al., Current Protocols in Immunology 18.3.1 (1998); Sidney, et al., J. Immunol. 154:247 (1995); Sette, et al., Mol. Immunol. 31:813 (1994)). Briefly, purified MHC molecules (5 to 500 nM) are incubated with various unlabeled peptide inhibitors and 1-10 nM $^{125}$I-radiolabeled probe peptides as described. Following incubation, MHC-peptide complexes are separated from free peptide by gel filtration and the fraction of peptide bound is determined. Typically, in preliminary experiments, each MHC preparation is titered in the presence of fixed amounts of radiolabeled peptides to determine the concentration of HLA molecules necessary to bind 10-20% of the total radioactivity. All subsequent inhibition and direct binding assays are performed using these HLA concentrations.

Since under these conditions [label]<[HLA] and $IC_{50} \geq$ [HLA], the measured $IC_{50}$ values are reasonable approximations of the true $K_D$ values. Peptide inhibitors are typically tested at concentrations ranging from 120 µg/ml to 1.2 ng/ml, and are tested in two to four completely independent experiments. To allow comparison of the data obtained in different experiments, a relative binding figure is calculated for each peptide by dividing the $IC_{50}$ of a positive control for inhibition by the $IC_{50}$ for each tested peptide (typically unlabeled versions of the radiolabeled probe peptide). For database purposes, and inter-experiment comparisons, relative binding values are compiled. These values can subsequently be converted back into $IC_{50}$ nM values by dividing the $IC_{50}$ nM of the positive controls for inhibition by the relative binding of the peptide of interest. This method of data compilation is accurate and consistent for comparing peptides that have been tested on different days, or with different lots of purified MHC.

Binding assays as outlined above may be used to analyze HLA supermotif and/or HLA motif-bearing peptides.

Example 11

Identification of HLA Supermotif- and Motif-Bearing CTL Candidate Epitopes

HLA vaccine compositions of the invention can include multiple epitopes. The multiple epitopes can comprise multiple HLA supermotifs or motifs to achieve broad population coverage. This example illustrates the identification and confirmation of supermotif- and motif-bearing epitopes for the inclusion in such a vaccine composition. Calculation of population coverage is performed using the strategy described below.

Computer Searches and Algorithms for Identification of Supermotif and/or Motif-Bearing Epitopes The searches performed to identify the motif-bearing peptide sequences in the Example entitled "Antigenicity Profiles" and Tables V-XVIII, XXVI, and XXVII employ the protein sequence data from the gene product of 193P1E1B set forth in FIGS. 2 and 3.

Computer searches for epitopes bearing HLA Class I or Class II supermotifs or motifs are performed as follows. All translated 193P1E1B protein sequences are analyzed using a text string search software program to identify potential peptide sequences containing appropriate HLA binding motifs; such programs are readily produced in accordance with information in the art in view of known motif/supermotif disclosures. Furthermore, such calculations can be made mentally.

Identified A2-, A3-, and DR-supermotif sequences are scored using polynomial algorithms to predict their capacity to bind to specific HLA-Class I or Class II molecules. These polynomial algorithms account for the impact of different amino acids at different positions, and are essentially based on the premise that the overall affinity (or ΔG) of peptide-HLA molecule interactions can be approximated as a linear polynomial function of the type:

"ΔG"=$a_{1i} \times a_{2i} \times a_{3i} \ldots \times a_{ni}$ where $a_{ji}$ is a coefficient which represents the effect of the presence of a given amino acid (j) at a given position (i) along the sequence of a peptide of n amino acids. The crucial assumption of this method is that the effects at each position are essentially independent of each other (i.e., independent binding of individual side-chains). When residue j occurs at position i in the peptide, it is assumed to contribute a constant amount $j_i$ to the free energy of binding of the peptide irrespective of the sequence of the rest of the peptide.

The method of derivation of specific algorithm coefficients has been described in Gulukota et al., *J. Mol. Biol.* 267:1258-126, 1997; (see also Sidney et al., *Human Immunol.* 45:79-93, 1996; and Southwood et al., *J. Immunol.* 160:3363-3373, 1998). Briefly, for all i positions, anchor and non-anchor alike, the geometric mean of the average relative binding (ARB) of all peptides carrying j is calculated relative to the remainder of the group, and used as the estimate of $j_i$. For Class II peptides, if multiple alignments are possible, only the highest scoring alignment is utilized, following an iterative procedure. To calculate an algorithm score of a given peptide in a test set, the ARB values corresponding to the sequence of the peptide are multiplied. If this product exceeds a chosen threshold, the peptide is predicted to bind. Appropriate thresholds are chosen as a function of the degree of stringency of prediction desired.

Selection of HLA-A2 Supertype Cross-Reactive Peptides

Protein sequences from 193P1E1B are scanned utilizing motif identification software, to identify 8-, 9- 10- and 11-mer sequences containing the HLA-A2-supermotif main anchor specificity. Typically, these sequences are then scored using the protocol described above and the peptides corresponding to the positive-scoring sequences are synthesized and tested for their capacity to bind purified HLA-A*0201 molecules in vitro (HLA-A*0201 is considered a prototype A2 supertype molecule).

These peptides are then tested for the capacity to bind to additional A2-supertype molecules (A*0202, A*0203, A*0206, and A*6802). Peptides that bind to at least three of the five A2-supertype alleles tested are typically deemed A2-supertype cross-reactive binders. Preferred peptides bind at an affinity equal to or less than 500 nM to three or more HLA-A2 supertype molecules.

Selection of HLA-A3 Supermotif-Bearing Epitopes

The 193P1E1B protein sequence(s) scanned above is also examined for the presence of peptides with the HLA-A3-supermotif primary anchors. Peptides corresponding to the HLA A3 supermotif-bearing sequences are then synthesized and tested for binding to HLA-A*0301 and HLA-A*1101 molecules, the molecules encoded by the two most prevalent A3-supertype alleles. The peptides that bind at least one of the two alleles with binding affinities of ≦500 nM, often ≦200 nM, are then tested for binding cross-reactivity to the other common A3-supertype alleles (e.g., A*3101, A*3301, and A*6801) to identify those that can bind at least three of the five HLA-A3-supertype molecules tested.

Selection of HLA-B7 Supermotif Bearing Epitopes

The 193P1E1B protein(s) scanned above is also analyzed for the presence of 8-, 9- 10-, or 11-mer peptides with the HLA-B7-supermotif. Corresponding peptides are synthesized and tested for binding to HLA-B*0702, the molecule encoded by the most common B7-supertype allele (i.e., the prototype B7 supertype allele). Peptides binding B*0702 with $IC_{50}$ of ≦500 nM are identified using standard methods. These peptides are then tested for binding to other common B7-supertype molecules (e.g., B*3501, B*5101, B*5301, and B*5401). Peptides capable of binding to three or more of the five B7-supertype alleles tested are thereby identified.

Selection of A1 and A24 Motif-Bearing Epitopes

To further increase population coverage, HLA-A1 and -A24 epitopes can also be incorporated into vaccine compositions. An analysis of the 193P1E1B protein can also be performed to identify HLA-A1- and A24-motif-containing sequences.

High affinity and/or cross-reactive binding epitopes that bear other motif and/or supermotifs are identified using analogous methodology.

Example 12

Confirmation of Immunogenicity

Cross-reactive candidate CTL A2-supermotif-bearing peptides that are identified as described herein are selected to confirm in vitro immunogenicity. Confirmation is performed using the following methodology:

Target Cell Lines for Cellular Screening:

The 0.221A2.1 cell line, produced by transferring the HLA-A2.1 gene into the HLA-A, -B, -C null mutant human B-lymphoblastoid cell line 721.221, is used as the peptide-loaded target to measure activity of HLA-A2.1-restricted CTL. This cell line is grown in RPMI-1640 medium supplemented with antibiotics, sodium pyruvate, nonessential amino acids and 10% (v/v) heat inactivated FCS. Cells that express an antigen of interest, or transfectants comprising the gene encoding the antigen of interest, can be used as target cells to confirm the ability of peptide-specific CTLs to recognize endogenous antigen.

Primary CTL Induction Cultures:

Generation of Dendritic Cells (DC): PBMCs are thawed in RPMI with 30 μg/ml DNAse, washed twice and resuspended in complete medium (RPMI-1640 plus 5% AB human serum, non-essential amino acids, sodium pyruvate, L-glutamine and penicillin/streptomycin). The monocytes are purified by plating $10 \times 10^6$ PBMC/well in a 6-well plate. After 2 hours at 37° C., the non-adherent cells are removed by gently shaking the plates and aspirating the supernatants. The wells are washed a total of three times with 3 ml RPMI to remove most of the non-adherent and loosely adherent cells. Three ml of complete medium containing 50 ng/ml of GM-CSF and 1,000 U/ml of IL-4 are then added to each well. TNFα is added to the DCs on day 6 at 75 ng/ml and the cells are used for CTL induction cultures on day 7.

Induction of CTL with DC and Peptide: CD8+ T-cells are isolated by positive selection with Dynal immunomagnetic beads (Dynabeads® M-450) and the detacha-bead® reagent. Typically about $200\text{-}250 \times 10^6$ PBMC are processed to obtain $24 \times 10^6$ CD8$^+$ T-cells (enough for a 48-well plate culture). Briefly, the PBMCs are thawed in RPMI with 30 μg/ml DNAse, washed once with PBS containing 1% human AB serum and resuspended in PBS/1% AB serum at a concentration of $20 \times 10^6$ cells/ml. The magnetic beads are washed 3 times with PBS/AB serum, added to the cells (140 μl beads/$20 \times 10^6$ cells) and incubated for 1 hour at 4° C. with continuous mixing. The beads and cells are washed 4×with PBS/AB serum to remove the nonadherent cells and resuspended at $100 \times 10^6$ cells/ml (based on the original cell number) in PBS/AB serum containing 100 μl/ml detacha-bead® reagent and 30 μg/ml DNAse. The mixture is incubated for 1 hour at room temperature with continuous mixing. The beads are washed again with PBS/AB/DNAse to collect the CD8+ T-cells. The DC are collected and centrifuged at 1300 rpm for 5-7 minutes, washed once with PBS with 1% BSA, counted and pulsed with 40 μg/ml of peptide at a cell concentration of $1$-$2 \times 10^6$/ml in the presence of 3 μg/ml $\beta_2$-microglobulin for 4 hours at 20° C. The DC are then irradiated (4,200 rads), washed 1 time with medium and counted again.

Setting up induction cultures: 0.25 ml cytokine-generated DC (at $1 \times 10^5$ cells/ml) are co-cultured with 0.25 ml of CD8+ T-cells (at $2 \times 10^6$ cell/ml) in each well of a 48-well plate in the presence of 10 ng/ml of IL-7. Recombinant human IL-10 is added the next day at a final concentration of 10 ng/ml and rhuman IL-2 is added 48 hours later at 10 IU/ml.

Restimulation of the induction cultures with peptide-pulsed adherent cells: Seven and fourteen days after the primary induction, the cells are restimulated with peptide-pulsed adherent cells. The PBMCs are thawed and washed twice with RPMI and DNAse. The cells are resuspended at $5 \times 10^6$ cells/ml and irradiated at ~4200 rads. The PBMCs are plated at $2 \times 10^6$ in 0.5 ml complete medium per well and incubated for 2 hours at 37° C. The plates are washed twice with RPMI by tapping the plate gently to remove the nonadherent cells and the adherent cells pulsed with 10 μg/ml of peptide in the presence of 3 μg/ml ß2 microglobulin in 0.25 ml RPMI/5% AB per well for 2 hours at 37° C. Peptide solution from each well is aspirated and the wells are washed once with RPMI. Most of the media is aspirated from the induction cultures (CD8+cells) and brought to 0.5 ml with fresh media. The cells are then transferred to the wells containing the peptide-pulsed adherent cells. Twenty four hours later recombinant human IL-10 is added at a final concentration of 10 ng/ml and recombinant human IL2 is added the next day and again 2-3 days later at 50 IU/ml (Tsai et al., *Critical Reviews in Immunology* 18(1-2):65-75, 1998). Seven days later, the cultures are assayed for CTL activity in a $^{51}$Cr release assay. In some experiments the cultures are assayed for peptide-specific recognition in the in situ IFNγ ELISA at the time of the second restimulation followed by assay of endogenous recognition 7 days later. After expansion, activity is measured in both assays for a side-by-side comparison.

Measurement of CTL Lytic Activity by $^{51}$Cr Release.

Seven days after the second restimulation, cytotoxicity is determined in a standard (5 hr) $^{51}$Cr release assay by assaying individual wells at a single E:T. Peptide-pulsed targets are prepared by incubating the cells with 10 μg/ml peptide overnight at 37° C.

Adherent target cells are removed from culture flasks with trypsin-EDTA. Target cells are labeled with 200 μCi of $^{51}$Cr sodium chromate (Dupont, Wilmington, Del.) for 1 hour at 37° C. Labeled target cells are resuspended at $10^6$ per ml and diluted 1:10 with K562 cells at a concentration of $3.3 \times 10^6$/ml (an NK-sensitive erythroblastoma cell line used to reduce non-specific lysis). Target cells (100 μl) and effectors (1001 μl) are plated in 96 well round-bottom plates and incubated for 5 hours at 37° C. At that time, 100 μl of supernatant are collected from each well and percent lysis is determined according to the formula:

[(cpm of the test sample–cpm of the spontaneous $^{51}$Cr release sample)/(cpm of the maximal $^{51}$Cr release sample–cpm of the spontaneous $^{51}$Cr release sample)]×100.

Maximum and spontaneous release are determined by incubating the labeled targets with 1% Triton X-100 and media alone, respectively. A positive culture is defined as one in which the specific lysis (sample-background) is 10% or higher in the case of individual wells and is 15% or more at the two highest E:T ratios when expanded cultures are assayed.

In Situ Measurement of Human IFNγ Production as an Indicator of Peptide-Specific and Endogenous Recognition Immulon 2 plates are coated with mouse anti-human IFNγ monoclonal antibody (4 μg/ml 0.1M $NaHCO_3$, pH 8.2) overnight at 4° C. The plates are washed with $Ca^{2+}$, $Mg^{2+}$-free PBS/0.05% Tween 20 and blocked with PBS/10% FCS for two hours, after which the CTLs (100 μl/well) and targets (100 μl/well) are added to each well, leaving empty wells for the standards and blanks (which received media only). The target cells, either peptide-pulsed or endogenous targets, are used at a concentration of $1 \times 10^6$ cells/ml. The plates are incubated for 48 hours at 37° C. with 5% $CO_2$.

Recombinant human IFN-gamma is added to the standard wells starting at 400 pg or 1200 pg/100 microliter/well and the plate incubated for two hours at 37° C. The plates are washed and 100 μl of biotinylated mouse anti-human IFN-gamma monoclonal antibody (2 microgram/ml in PBS/3%FCS/0.05% Tween 20) are added and incubated for 2 hours at room temperature. After washing again, 100 microliter HRP-streptavidin (1:4000) are added and the plates incubated for one hour at room temperature. The plates are then washed 6×with wash buffer, 100 microliter/well developing solution (TMB 1:1) are added, and the plates allowed to develop for 5-15 minutes. The reaction is stopped with 50 microliter/well 1M $H_3PO_4$ and read at OD450. A culture is considered positive if it measured at least 50 pg of IFN-gamma/well above background and is twice the background level of expression.

CTL Expansion.

Those cultures that demonstrate specific lytic activity against peptide-pulsed targets and/or tumor targets are expanded over a two week period with anti-CD3. Briefly, $5 \times 10^4$ CD8+ cells are added to a T25 flask containing the following: $1 \times 10^6$ irradiated (4,200 rad) PBMC (autologous or allogeneic) per ml, $2 \times 10^5$ irradiated (8,000 rad) EBV-transformed cells per ml, and OKT3 (anti-CD3) at 30 ng per ml in RPMI-1640 containing 10% (v/v) human AB serum, non-essential amino acids, sodium pyruvate, 25 μM 2-mercaptoethanol, L-glutamine and penicillin/streptomycin. Recombinant human IL2 is added 24 hours later at a final concentration of 200 IU/ml and every three days thereafter with fresh media at 50 IU/ml. The cells are split if the cell concentration exceeds $1 \times 10^6$/ml and the cultures are assayed between days 13 and 15 at E:T ratios of 30, 10, 3 and 1:1 in the $^{51}$Cr release assay or at $1 \times 10^6$/ml in the in situ IFNγ assay using the same targets as before the expansion.

Cultures are expanded in the absence of anti-CD3+ as follows. Those cultures that demonstrate specific lytic activity against peptide and endogenous targets are selected and $5 \times 10^4$ CD8+ cells are added to a T25 flask containing the following: $1 \times 10^6$ autologous PBMC per ml which have been peptide-pulsed with 10 μg/ml peptide for two hours at 37° C. and irradiated (4,200 rad); $2 \times 10^5$ irradiated (8,000 rad) EBV-transformed cells per ml RPMI-1640 containing 10% (v/v) human AB serum, non-essential AA, sodium pyruvate, 25 mM 2-ME, L-glutamine and gentamicin.

Immunogenicity of A2 Supermotif-Bearing Peptides

A2-supermotif cross-reactive binding peptides are tested in the cellular assay for the ability to induce peptide-specific CTL in normal individuals. In this analysis, a peptide is typically considered to be an epitope if it induces peptide-specific CTLs in at least individuals, and preferably, also recognizes the endogenously expressed peptide.

Immunogenicity can also be confirmed using PBMCs isolated from patients bearing a tumor that expresses 193P1E1B. Briefly, PBMCs are isolated from patients, re-stimulated with peptide-pulsed monocytes and assayed for the ability to recognize peptide-pulsed target cells as well as transfected cells endogenously expressing the antigen.

Evaluation of A*03/A11 Immunogenicity

HLA-A3 supermotif-bearing cross-reactive binding peptides are also evaluated for immunogenicity using methodology analogous for that used to evaluate the immunogenicity of the HLA-A2 supermotif peptides.

Evaluation of B7 Immunogencity

Immunogenicity screening of the B7-supertype cross-reactive binding peptides identified as set forth herein are confirmed in a manner analogous to the confirmation of A2-and A3-supermotif-bearing peptides.

Peptides bearing other supermotifs/motifs, e.g., HLA-A1, HLA-A24 etc. are also confirmed using similar methodology Example 13

Implementation of the Extended Supermotif to Improve the Binding Capacity of Native Epitopes by Creating Analogs HLA motifs and supermotifs (comprising primary and/or secondary residues) are useful in the identification and preparation of highly cross-reactive native peptides, as demonstrated herein. Moreover, the definition of HLA motifs and supermotifs also allows one to engineer highly cross-reactive epitopes by identifying residues within a native peptide sequence which can be analoged to confer upon the peptide certain characteristics, e.g. greater cross-reactivity within the group of HLA molecules that comprise a supertype, and/or greater binding affinity for some or all of those HLA molecules. Examples of analoging peptides to exhibit modulated binding affinity are set forth in this example.

Analoging at Primary Anchor Residues

Peptide engineering strategies are implemented to further increase the cross-reactivity of the epitopes. For example, the main anchors of A2-supermotif-bearing peptides are altered, for example, to introduce a preferred L, I, V, or M at position 2, and I or V at the C-terminus.

To analyze the cross-reactivity of the analog peptides, each engineered analog is initially tested for binding to the prototype A2 supertype allele A*0201, then, if A*0201 binding capacity is maintained, for A2-supertype cross-reactivity.

Alternatively, a peptide is confirmed as binding one or all supertype members and then analoged to modulate binding affinity to any one (or more) of the supertype members to add population coverage.

The selection of analogs for immunogenicity in a cellular screening analysis is typically further restricted by the capacity of the parent wild type (WT) peptide to bind at least weakly, i.e., bind at an $IC_{50}$ of 5000 nM or less, to three of more A2 supertype alleles. The rationale for this requirement is that the WT peptides must be present endogenously in sufficient quantity to be biologically relevant. Analoged peptides have been shown to have increased immunogenicity and cross-reactivity by T cells specific for the parent epitope (see, e.g., Parkhurst et al., *J. Immunol.* 157:2539, 1996; and Pogue et al., *Proc. Natl. Acad. Sci. USA* 92:8166, 1995).

In the cellular screening of these peptide analogs, it is important to confirm that analog-specific CTLs are also able to recognize the wild-type peptide and, when possible, target cells that endogenously express the epitope.

Analoging of HLA-A3 and B7-Supernotif-Bearing Peptides

Analogs of HLA-A3 supermotif-bearing epitopes are generated using strategies similar to those employed in analoging HLA-A2 supermotif-bearing peptides. For example, peptides binding to 3/5 of the A3-supertype molecules are engineered at primary anchor residues to possess a preferred residue (V, S, M, or A) at position 2.

The analog peptides are then tested for the ability to bind A*03 and A*11 (prototype A3 supertype alleles). Those peptides that demonstrate $\leq$500 nM binding capacity are then confirmed as having A3-supertype cross-reactivity.

Similarly to the A2- and A3-motif bearing peptides, peptides binding 3 or more B7-supertype alleles can be improved, where possible, to achieve increased cross-reactive binding or greater binding affinity or binding half life. B7 supermotif-bearing peptides are, for example, engineered to possess a preferred residue (V, I, L, or F) at the C-terminal primary anchor position, as demonstrated by Sidney et al. (*J. Immunol.* 157:3480-3490, 1996).

Analoging at primary anchor residues of other motif and/or supermotif-bearing epitopes is performed in a like manner.

The analog peptides are then be confirmed for immunogenicity, typically in a cellular screening assay. Again, it is generally important to demonstrate that analog-specific CTLs are also able to recognize the Wild-type peptide and, when possible, targets that endogenously express the epitope.

Analoging at Secondary Anchor Residues

Moreover, HLA supermotifs are of value in engineering highly cross-reactive peptides and/or peptides that bind HLA molecules with increased affinity by identifying particular residues at secondary anchor positions that are associated with such properties. For example, the binding capacity of a B7 supermotif-bearing peptide with an F residue at position 1 is analyzed. The peptide is then analoged to, for example, substitute L for F at position 1. The analoged peptide is evaluated for increased binding affinity, binding half life and/or increased cross-reactivity. Such a procedure identifies analoged peptides with enhanced properties.

Engineered analogs with sufficiently improved binding capacity or cross-reactivity can also be tested for immunogenicity in HLA-B7-transgenic mice, following for example, IFA immunization or lipopeptide immunization. Analoged peptides are additionally tested for the ability to stimulate a recall response using PBMC from patients with 193P1E1B-expressing tumors.

Other Analoging Strategies

Another form of peptide analoging, unrelated to anchor positions, involves the substitution of a cysteine with α-amino butyric acid. Due to its chemical nature, cysteine has the propensity to form disulfide bridges and sufficiently alter the peptide structurally so as to reduce binding capacity. Substitution of α-amino butyric acid for cysteine not only alleviates this problem, but has been shown to improve binding and crossbinding capabilities in some instances (see, e.g., the review by Sette et al., In: Persistent Viral Infections, Eds. R. Ahmed and I. Chen, John Wiley & Sons, England, 1999).

Thus, by the use of single amino acid substitutions, the binding properties and/or cross-reactivity of peptide ligands for HLA supertype molecules can be modulated.

Example 14

Identification and Confirmation of 193P1E1B-Derived Sequences with HLA-DR Binding Motifs Peptide epitopes bearing an HLA class II supermotif or motif are identified and confirmed as outlined below using methodology similar to that described for HLA Class I peptides.

Selection of HLA-DR-Supermotif-Bearing Epitopes.

To identify 193P1E1B-derived, HLA class II HTL epitopes, a 193P1E1B antigen is analyzed for the presence of sequences bearing an HLA-DR-motif or supermotif. Specifically, 15-mer sequences are selected comprising a DR-supermotif, comprising a 9-mer core, and three-residue N- and C-terminal flanking regions (15 amino acids total).

Protocols for predicting peptide binding to DR molecules have been developed (Southwood et al., *J. Immunol.* 160: 3363-3373, 1998). These protocols, specific for individual DR molecules, allow the scoring, and ranking, of 9-mer core regions. Each protocol not only scores peptide sequences for the presence of DR-supermotif primary anchors (i.e., at position 1 and position 6) within a 9-mer core, but additionally evaluates sequences for the presence of secondary anchors. Using allele-specific selection tables (see, e.g., Southwood et al., ibid.), it has been found that these protocols efficiently select peptide sequences with a high probability of binding a particular DR molecule. Additionally, it has been found that performing these protocols in tandem, specifically those for DR1, DR4w4, and DR7, can efficiently select DR cross-reactive peptides.

The 193P1E1B-derived peptides identified above are tested for their binding capacity for various common HLA-DR molecules. All peptides are initially tested for binding to the DR molecules in the primary panel: DR1, DR4w4, and DR7. Peptides binding at least two of these three DR molecules are then tested for binding to DR2w2 β1, DR2w2 β2, DR6w19, and DR9 molecules in secondary assays. Finally, peptides binding at least two of the four secondary panel DR molecules, and thus cumulatively at least four of seven different DR molecules, are screened for binding to DR4w15, DR5w11, and DR8w2 molecules in tertiary assays. Peptides binding at least seven of the ten DR molecules comprising the primary, secondary, and tertiary screening assays are considered cross-reactive DR binders. 193P1E1B-derived peptides found to bind common HLA-DR alleles are of particular interest.

Selection of DR3 Motif Peptides

Because HLA-DR3 is an allele that is prevalent in Caucasian, Black, and Hispanic populations, DR3 binding capacity is a relevant criterion in the selection of HTL epitopes. Thus, peptides shown to be candidates may also be assayed for their DR3 binding capacity. However, in view of the binding specificity of the DR3 motif, peptides binding only to DR3 can also be considered as candidates for inclusion in a vaccine formulation.

To efficiently identify peptides that bind DR3, target 193P1E1B antigens are analyzed for sequences carrying one of the two DR3-specific binding motifs reported by Geluk et al. (*J. Immunol.* 152:5742-5748, 1994). The corresponding peptides are then synthesized and confirmed as having the ability to bind DR3 with an affinity of 1 μM or better, i.e., less than 1 μM. Peptides are found that meet this binding criterion and qualify as HLA class II high affinity binders.

DR3 binding epitopes identified in this manner are included in vaccine compositions with DR supermotif-bearing peptide epitopes.

Similarly to the case of HLA class I motif-bearing peptides, the class II motif-bearing peptides are analoged to improve affinity or cross-reactivity. For example, aspartic acid at position 4 of the 9-mer core sequence is an optimal residue for DR3 binding, and substitution for that residue often improves DR 3 binding.

Example 15

Immunogenicity of 193P1E1B-Derived HTL Epitopes

This example determines immunogenic DR supermotif- and DR3 motif-bearing epitopes among those identified using the methodology set forth herein.

Immunogenicity of HTL epitopes are confirmed in a manner analogous to the determination of immunogenicity of CTL epitopes, by assessing the ability to stimulate HTL responses and/or by using appropriate transgenic mouse models. Immunogenicity is determined by screening for: 1.) in vitro primary induction using normal PBMC or 2.) recall responses from patients who have 193P1E1B-expressing tumors.

Example 16

Calculation of Phenotypic Frequencies of HLA-Supertypes in Various Ethnic Backgrounds to Determine Breadth of Population Coverage This example illustrates the assessment of the breadth of population coverage of a vaccine composition comprised of multiple epitopes comprising multiple supermotifs and/or motifs.

In order to analyze population coverage, gene frequencies of HLA alleles are determined. Gene frequencies for each HLA allele are calculated from antigen or allele frequencies utilizing the binomial distribution formulae gf=1−(SQRT(1−af)) (see, e.g., Sidney et al., *Human Immunol.* 45:79-93, 1996). To obtain overall phenotypic frequencies, cumulative gene frequencies are calculated, and the cumulative antigen frequencies derived by the use of the inverse formula [af=1−$(1-Cgf)^2$].

Where frequency data is not available at the level of DNA typing, correspondence to the serologically defined antigen frequencies is assumed. To obtain total potential supertype population coverage no linkage disequilibrium is assumed, and only alleles confirmed to belong to each of the supertypes are included (minimal estimates). Estimates of total potential coverage achieved by inter-loci combinations are made by adding to the A coverage the proportion of the non-A covered population that could be expected to be covered by the B alleles considered (e.g., total=A+B*(1−A)). Confirmed members of the A3-like supertype are A3, A11, A31, A*3301, and A*6801. Although the A3-like supertype may also include A34, A66, and A*7401, these alleles were not included in overall frequency calculations. Likewise, confirmed members of the A2-like supertype family are A*0201, A*0202, A*0203, A*0204, A*0205, A*0206, A*0207, A*6802, and A*6901. Finally, the B7-like supertype-confirmed alleles are: B7, B*3501-03, B51, B*5301, B*5401, B*5501-2, B*5601, B*6701, and B*7801 (potentially also B*1401, B*3504-06, B*4201, and B*5602).

Population coverage achieved by combining the A2-, A3- and B7-supertypes is approximately 86% in five major ethnic groups. Coverage may be extended by including peptides bearing the A1 and A24 motifs. On average, A1 is present in 12% and A24 in 29% of the population across five different major ethnic groups (Caucasian, North American Black, Chinese, Japanese, and Hispanic). Together, these alleles are represented with an average frequency of 39% in these same ethnic populations. The total coverage across the major ethnicities when A1 and A24 are combined with the coverage of the A2-, A3- and B7-supertype alleles is >95%. An analogous approach can be used to estimate population coverage achieved with combinations of class II motif-bearing epitopes.

Immunogenicity studies in humans (e.g., Bertoni et al., *J. Clin. Invest.* 100:503, 1997; Doolan et al., *Immunity* 7:97, 1997; and Threlkeld et al., *J. Immunol.* 159:1648, 1997) have shown that highly cross-reactive binding peptides are almost always recognized as epitopes. The use of highly cross-reactive binding peptides is an important selection criterion in identifying candidate epitopes for inclusion in a vaccine that is immunogenic in a diverse population.

With a sufficient number of epitopes (as disclosed herein and from the art), an average population coverage is predicted to be greater than 95% in each of five major ethnic populations. The game theory Monte Carlo simulation analysis, which is known in the art (see e.g., Osborne, M. J. and Rubinstein, A. "A course in game theory" MIT Press, 1994), can be used to estimate what percentage of the individuals in a population comprised of the Caucasian, North American Black, Japanese, Chinese, and Hispanic ethnic groups would recognize the vaccine epitopes described herein. A preferred percentage is 90%. A more preferred percentage is 95%.

Example 17

CTL Recognition of Endogenously Processed Antizens After Priming

This example confirms that CTL induced by native or analoged peptide epitopes identified and selected as described herein recognize endogenously synthesized, i.e., native antigens.

Effector cells isolated from transgenic mice that are immunized with peptide epitopes, for example HLA-A2 supermotif-bearing epitopes, are re-stimulated in vitro using peptide-coated stimulator cells. Six days later, effector cells are assayed for cytotoxicity and the cell lines that contain peptide-specific cytotoxic activity are further re-stimulated. An additional six days later, these cell lines are tested for cytotoxic activity on $^{51}$Cr labeled Jurkat-A2.1/K$^b$ target cells in the absence or presence of peptide, and also tested on $^{51}$Cr labeled target cells bearing the endogenously synthesized antigen, i.e. cells that are stably transfected with 193P1E1B expression vectors.

The results demonstrate that CTL lines obtained from animals primed with peptide epitope recognize endogenously synthesized 193P1E1B antigen. The choice of transgenic mouse model to be used for such an analysis depends upon the epitope(s) that are being evaluated. In addition to HLA-A*0201/K$^b$ transgenic mice, several other transgenic mouse models including mice with human A11, which may also be used to evaluate A3 epitopes, and B7 alleles have been characterized and others (e.g., transgenic mice for HLA-A1 and A24) are being developed. HLA-DR1 and HLA-DR3 mouse models have also been developed, which may be used to evaluate HTL epitopes.

Example 18

Activity of CTL-HTL Conjugated Epitopes in Transgenic Mice

This example illustrates the induction of CTLs and HTLs in transgenic mice, by use of a 193P1E1B-derived CTL and HTL peptide vaccine compositions. The vaccine composition used herein comprise peptides to be administered to a patient with a 193P1E1B-expressing tumor. The peptide composition can comprise multiple CTL and/or HTL epitopes. The epitopes are identified using methodology as described herein. This example also illustrates that enhanced immunogenicity can be achieved by inclusion of one or more HTL epitopes in a CTL vaccine composition; such a peptide composition can comprise an HTL epitope conjugated to a CTL epitope. The CTL epitope can be one that binds to multiple HLA family members at an affinity of 500 nM or less, or analogs of that epitope. The peptides may be lipidated, if desired.

Immunization procedures: Immunization of transgenic mice is performed as described (Alexander et al., *J. Immunol.* 159:4753-4761, 1997). For example, A2/K$^b$ mice, which are transgenic for the human HLA A2.1 allele and are used to confirm the immunogenicity of HLA-A*0201 motif- or HLA-A2 supermotif-bearing epitopes, and are primed subcutaneously (base of the tail) with a 0.1 ml of peptide in Incomplete Freund's Adjuvant, or if the peptide composition is a lipidated CTL/HTL conjugate, in DMSO/saline, or if the peptide composition is a polypeptide, in PBS or Incomplete Freund's Adjuvant. Seven days after priming, splenocytes obtained from these animals are restimulated with syngenic, irradiated LPS-activated lymphoblasts coated with peptide.

Cell lines: Target cells for peptide-specific cytotoxicity assays are Jurkat cells transfected with the HLA-A2.1/K$^b$ chimeric gene (e.g., Vitiello et al., *J. Exp. Med.* 173:1007, 1991)

In vitro CTL activation: One week after priming, spleen cells (30×10$^6$ cells/flask) are co-cultured at 37° C. with syngeneic, irradiated (3000 rads), peptide coated lymphoblasts (10×10$^6$ cells/flask) in 10 ml of culture medium/T25 flask. After six days, effector cells are harvested and assayed for cytotoxic activity.

Assay for cytotoxic activity: Target cells (1.0 to 1.5×10$^6$) are incubated at 37° C. in the presence of 200 µl of $^{51}$Cr. After 60 minutes, cells are washed three times and resuspended in R10 medium. Peptide is added where required at a concentration of 1 µg/ml. For the assay, 10$^4$ $^{51}$Cr-labeled target cells are added to different concentrations of effector cells (final volume of 200 µl) in U-bottom 96-well plates. After a six hour incubation period at 37° C., a 0.1 ml aliquot of supernatant is removed from each well and radioactivity is determined in a Micromedic automatic gamma counter. The percent specific lysis is determined by the formula: percent specific release=100×(experimental release–spontaneous release)/(maximum release–spontaneous release). To facilitate comparison between separate CTL assays run under the same conditions, % $^{51}$Cr release data is expressed as lytic units/10$^6$ cells. One lytic unit is arbitrarily defined as the number of effector cells required to achieve 30% lysis of 10,000 target cells in a six hour $^{51}$Cr release assay. To obtain specific lytic units/10$^6$, the lytic units/10$^6$ obtained in the absence of peptide is subtracted from the lytic units/10$^6$ obtained in the presence of peptide. For example, if 30% $^{51}$Cr release is obtained at the effector (E): target (T) ratio of 50:1 (i.e., 5×10$^5$ effector cells for 10,000 targets) in the absence of peptide and 5:1 (i.e., 5×10⁴ effector cells for 10,000 targets) in the presence of peptide, the specific lytic units would be: [($\frac{1}{50,000}$)−($\frac{1}{500,000}$)]×10⁶=18 LU.

The results are analyzed to assess the magnitude of the CTL responses of animals injected with the immunogenic CTL/HTL conjugate vaccine preparation and are compared to the magnitude of the CTL response achieved using, for example, CTL epitopes as outlined above in the Example entitled "Confirmation of immunogenicity". Analyses similar to this may be performed to confirm the immunogenicity of peptide conjugates containing multiple CTL epitopes and/or multiple HTL epitopes. In accordance with these procedures, it is found that a CTL response is induced, and concomitantly that an HTL response is induced upon administration of such compositions.

Example 19

Selection of CTL and HTL Epitopes for Inclusion in an 193P1E1B-Specific Vaccine

This example illustrates a procedure for selecting peptide epitopes for vaccine compositions of the invention. The peptides in the composition can be in the form of a nucleic acid sequence, either single or one or more sequences (i.e., minigene) that encodes peptide(s), or can be single and/or polyepitopic peptides.

The following principles are utilized when selecting a plurality of epitopes for inclusion in a vaccine composition. Each of the following principles is balanced in order to make the selection.

Epitopes are selected which, upon administration, mimic immune responses that are correlated with 193P1E1B clearance. The number of epitopes used depends on observations of patients who spontaneously clear 193P1E1B. For example, if it has been observed that patients who spontaneously clear 193P1E1B generate an immune response to at least three (3) from 193P1E1B antigen, then three or four (3-4) epitopes should be included for HLA class I. A similar rationale is used to determine HLA class II epitopes.

Epitopes are often selected that have a binding affinity of an $IC_{50}$ of 500 nM or less for an HLA class I molecule, or for class II, an $IC_{50}$ of 1000 nM or less; or HLA Class I peptides with high binding scores from the BIMAS web site, at URL bimas.dcrt.nih.gov/.

In order to achieve broad coverage of the vaccine through out a diverse population, sufficient supermotif bearing peptides, or a sufficient array of allele-specific motif bearing peptides, are selected to give broad population coverage. In one embodiment, epitopes are selected to provide at least 80% population coverage. A Monte Carlo analysis, a statistical evaluation known in the art, can be employed to assess breadth, or redundancy, of population coverage.

When creating polyepitopic compositions, or a minigene that encodes same, it is typically desirable to generate the smallest peptide possible that encompasses the epitopes of interest. The principles employed are similar, if not the same, as those employed when selecting a peptide comprising nested epitopes. For example, a protein sequence for the vaccine composition is selected because it has maximal number of epitopes contained within the sequence, i.e., it has a high concentration of epitopes. Epitopes may be nested or overlapping (i.e., frame shifted relative to one another). For example, with overlapping epitopes, two 9-mer epitopes and one 10-mer epitope can be present in a 10 amino acid peptide. Each epitope can be exposed and bound by an HLA molecule upon administration of such a peptide. A multi-epitopic, peptide can be generated synthetically, recombinantly, or via cleavage from the native source. Alternatively, an analog can be made of this native sequence, whereby one or more of the epitopes comprise substitutions that alter the cross-reactivity and/or binding affinity properties of the polyepitopic peptide. Such a vaccine composition is administered for therapeutic or prophylactic purposes. This embodiment provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (absent the creating of any analogs) directs the immune response to multiple peptide sequences that are actually present in 193P1E1B, thus avoiding the need to evaluate any junctional epitopes. Lastly, the embodiment provides an economy of scale when producing nucleic acid vaccine compositions. Related to this embodiment, computer programs can be derived in accordance with principles in the art, which identify in a target sequence, the greatest number of epitopes per sequence length.

A vaccine composition comprised of selected peptides, when administered, is safe, efficacious, and elicits an immune response similar in magnitude to an immune response that controls or clears cells that bear or overexpress 193P1E1B.

Example 20

Construction of "Minigene" Multi-Epitope DNA Plasmids

This example discusses the construction of a minigene expression plasmid. Minigene plasmids may, of course, contain various configurations of B cell, CTL and/or HTL epitopes or epitope analogs as described herein.

A minigene expression plasmid typically includes multiple CTL and HTL peptide epitopes. In the present example, HLA-A2, -A3, -B7 supermotif-bearing peptide epitopes and HLA-A1 and -A24 motif-bearing peptide epitopes are used in conjunction with DR supermotif-bearing epitopes and/or DR3 epitopes. HLA class I supermotif or motif-bearing peptide epitopes derived 193P1E1B, are selected such that multiple supermotifs/motifs are represented to ensure broad population coverage. Similarly, HLA class II epitopes are selected from 193P1E1B to provide broad population coverage, i.e. both HLA DR-1-4-7 supermotif-bearing epitopes and HLA DR-3 motif-bearing epitopes are selected for inclusion in the minigene construct. The selected CTL and HTL epitopes are then incorporated into a minigene for expression in an expression vector.

Such a construct may additionally include sequences that direct the HTL epitopes to the endoplasmic reticulum. For example, the Ii protein may be fused to one or more HTL epitopes as described in the art, wherein the CLIP sequence of the Ii protein is removed and replaced with an HLA class II epitope sequence so that HLA class II epitope is directed to the endoplasmic reticulum, where the epitope binds to an HLA class II molecules.

This example illustrates the methods to be used for construction of a minigene-bearing expression plasmid. Other expression vectors that may be used for minigene compositions are available and known to those of skill in the art.

The minigene DNA plasmid of this example contains a consensus Kozak sequence and a consensus murine kappa Ig-light chain signal sequence followed by CTL and/or HTL epitopes selected in accordance with principles disclosed herein. The sequence encodes an open reading frame fused to the Myc and His antibody epitope tag coded for by the pcDNA 3.1 Myc-His vector.

Overlapping oligonucleotides that can, for example, average about 70 nucleotides in length with 15 nucleotide overlaps, are synthesized and HPLC-purified. The oligonucleotides encode the selected peptide epitopes as well as appropriate linker nucleotides, Kozak sequence, and signal sequence. The final multiepitope minigene is assembled by extending the overlapping oligonucleotides in three sets of reactions using PCR. A Perkin/Elmer 9600 PCR machine is used and a total of 30 cycles are performed using the following conditions: 95° C. for 15 sec, annealing temperature (5° below the lowest calculated Tm of each primer pair) for 30 sec, and 72° C. for 1 min.

For example, a minigene is prepared as follows. For a first PCR reaction, 5 μg of each of two oligonucleotides are annealed and extended: In an example using eight oligonucleotides, i.e., four pairs of primers, oligonucleotides 1+2, 3+4, 5+6, and 7+8 are combined in 100 μl reactions containing Pfu polymerase buffer (1×=10 mM KCL, 10 mM $(NH4)_2SO_4$, 20 mM Tris-chloride, pH 8.75, 2 mM $MgSO_4$, 0.1% Triton X-100, 100 μg/ml BSA), 0.25 mM each dNTP, and 2.5 U of Pfu polymerase. The full-length dimer products are gel-purified, and two reactions containing the product of 1+2 and 3+4, and the product of 5+6 and 7+8 are mixed, annealed, and extended for 10 cycles. Half of the two reactions are then mixed, and 5 cycles of annealing and extension carried out before flanking primers are added to amplify the full length product. The full-length product is gel-purified and cloned into pCR-blunt (Invitrogen) and individual clones are screened by sequencing.

Example 21

The Plasmid Construct and the Degree to which it Induces Immunogenicity

The degree to which a plasmid construct, for example a plasmid constructed in accordance with the previous Example, is able to induce immunogenicity is confirmed in vitro by determining epitope presentation by APC following transduction or transfection of the APC with an epitope-expressing nucleic acid construct. Such a study determines "antigenicity" and allows the use of human APC. The assay determines the ability of the epitope to be presented by the APC in a context that is recognized by a T cell by quantifying the density of epitope-HLA class I complexes on the cell surface. Quantitation can be performed by directly measuring the amount of peptide eluted from the APC (see, e.g., Sijts et al., *J. Immunol.* 156:683-692, 1996; Demotz et al., *Nature* 342:682-684, 1989); or the number of peptide-HLA class I complexes can be estimated by measuring the amount of lysis or lymphokine release induced by diseased or transfected target cells, and then determining the concentration of peptide necessary to obtain equivalent levels of lysis or lymphokine release (see, e.g., Kageyama et al., *J. Immunol.* 154:567-576, 1995).

Alternatively, immunogenicity is confirmed through in vivo injections into mice and subsequent in vitro assessment of CTL and HTL activity, which are analyzed using cytotoxicity and proliferation assays, respectively, as detailed e.g., in Alexander et al., *Immunity* 1:751-761, 1994.

For example, to confirm the capacity of a DNA minigene construct containing at least one HLA-A2 supermotif peptide to induce CTLs in vivo, HLA-A2.1 $K^b$ transgenic mice, for example, are immunized intramuscularly with 100 μg of naked cDNA. As a means of comparing the level of CTLs induced by cDNA immunization, a control group of animals is also immunized with an actual peptide composition that comprises multiple epitopes synthesized as a single polypeptide as they would be encoded by the minigene.

Splenocytes from immunized animals are stimulated twice with each of the respective compositions (peptide epitopes encoded in the minigene or the polyepitopic peptide), then assayed for peptide-specific cytotoxic activity in a $^{51}Cr$ release assay. The results indicate the magnitude of the CTL response directed against the A2-restricted epitope, thus indicating the in vivo immunogenicity of the minigene vaccine and polyepitopic vaccine.

It is, therefore, found that the minigene elicits immune responses directed toward the HLA-A2 supermotif peptide epitopes as does the polyepitopic peptide vaccine. A similar analysis is also performed using other HLA-A3 and HLA-B7 transgenic mouse models to assess CTL induction by HLA-A3 and HLA-B7 motif or supermotif epitopes, whereby it is also found that the minigene elicits appropriate immune responses directed toward the provided epitopes.

To confirm the capacity of a class II epitope-encoding minigene to induce HTLs in vivo, DR transgenic mice, or for those epitopes that cross react with the appropriate mouse MHC molecule, I-$A^b$-restricted mice, for example, are immunized intramuscularly with 100 μg of plasmid DNA. As a means of comparing the level of HTLs induced by DNA immunization, a group of control animals is also immunized with an actual peptide composition emulsified in complete Freund's adjuvant. CD4+ T cells, i.e. HTLs, are purified from splenocytes of immunized animals and stimulated with each of the respective compositions (peptides encoded in the minigene). The HTL response is measured using a $^3H$-thymidine incorporation proliferation assay, (see, e.g., Alexander et al. *Immunity* 1:751-761, 1994). The results indicate the magnitude of the HTL response, thus demonstrating the in vivo immunogenicity of the minigene.

DNA minigenes, constructed as described in the previous Example, can also be confirmed as a vaccine in combination with a boosting agent using a prime boost protocol. The boosting agent can consist of recombinant protein (e.g., Barnett et al., *Aids Res. and Human Retroviruses* 14, Supplement 3:S299-S309, 1998) or recombinant vaccinia, for example, expressing a minigene or DNA encoding the complete protein of interest (see, e.g., Hanke et al., *Vaccine* 16:439-445, 1998; Sedegah et al., *Proc. Natl. Acad. Sci USA* 95:7648-53, 1998; Hanke and McMichael, *Immunol. Letters* 66:177-181, 1999; and Robinson et al., *Nature Med.* 5:526-34, 1999).

For example, the efficacy of the DNA minigene used in a prime boost protocol is initially evaluated in transgenic mice. In this example, A2.1/$K^b$ transgenic mice are immunized IM with 100 μg of a DNA minigene encoding the immunogenic peptides including at least one HLA-A2 supermotif-bearing peptide. After an incubation period (ranging from 3-9 weeks), the mice are boosted IP with $10^7$ pfu/mouse of a recombinant vaccinia virus expressing the same sequence encoded by the DNA minigene. Control mice are immunized with 100 μg of DNA or recombinant vaccinia without the minigene sequence, or with DNA encoding the minigene, but without the vaccinia boost. After an additional incubation period of two weeks, splenocytes from the mice are immediately assayed for peptide-specific activity in an ELISPOT assay. Additionally, splenocytes are stimulated in vitro with the A2-restricted peptide epitopes encoded in the minigene and recombinant vaccinia, then assayed for peptide-specific activity in an alpha, beta and/or gamma IFN ELISA.

It is found that the minigene utilized in a prime-boost protocol elicits greater immune responses toward the HLA-A2 supermotif peptides than with DNA alone. Such an analysis can also be performed using HLA-A11 or HLA-B7 transgenic mouse models to assess CTL induction by HLA-A3 or HLA-B7 motif or supermotif epitopes. The use of prime boost protocols in humans is described below in the Example entitled "Induction of CTL Responses Using a Prime Boost Protocol."

Example 22

Peptide Composition for Prophylactic Uses

Vaccine compositions of the present invention can be used to prevent 193P1E1B expression in persons who are at risk for tumors that bear this antigen. For example, a polyepitopic peptide epitope composition (or a nucleic acid comprising the same) containing multiple CTL and HTL epitopes such as those selected in the above Examples, which are also selected to target greater than 80% of the population, is administered to individuals at risk for a 193P1E1B-associated tumor.

For example, a peptide-based composition is provided as a single polypeptide that encompasses multiple epitopes. The vaccine is typically administered in a physiological solution that comprises an adjuvant, such as Incomplete Freunds Adjuvant. The dose of peptide for the initial immunization is from about 1 to about 50,000 μg, generally 100-5,000 μg, for a 70 kg patient. The initial administration of vaccine is followed by booster dosages at 4 weeks followed by evaluation of the magnitude of the immune response in the patient, by techniques that determine the presence of epitope-specific CTL populations in a PBMC sample. Additional booster doses are administered as required. The composition is found to be both safe and efficacious as a prophylaxis against 193P1E1B-associated disease.

Alternatively, a composition typically comprising transfecting agents is used for the administration of a nucleic acid-based vaccine in accordance with methodologies known in the art and disclosed herein.

Example 23

Polyepitopic Vaccine Compositions Derived from Native 193P1E1B Sequences

A native 193P1E1B polyprotein sequence is analyzed, preferably using computer algorithms defined for each class I and/or class II supermotif or motif, to identify "relatively short" regions of the polyprotein that comprise multiple epitopes. The "relatively short" regions are preferably less in length than an entire native antigen. This relatively short sequence that contains multiple distinct or overlapping, "nested" epitopes is selected; it can be used to generate a minigene construct. The construct is engineered to express the peptide, which corresponds to the native protein sequence. The "relatively short" peptide is generally less than 250 amino acids in length, often less than 100 amino acids in length, preferably less than 75 amino acids in length, and more preferably less than 50 amino acids in length. The protein sequence of the vaccine composition is selected because it has maximal number of epitopes contained within the sequence, i.e., it has a high concentration of epitopes. As noted herein, epitope motifs may be nested or overlapping (i.e., frame shifted relative to one another). For example, with overlapping epitopes, two 9-mer epitopes and one 10-mer epitope can be present in a 10 amino acid peptide. Such a vaccine composition is administered for therapeutic or prophylactic purposes.

The vaccine composition will include, for example, multiple CTL epitopes from 193P1E1B antigen and at least one HTL epitope. This polyepitopic native sequence is administered either as a peptide or as a nucleic acid sequence which encodes the peptide. Alternatively, an analog can be made of this native sequence, whereby one or more of the epitopes comprise substitutions that alter the cross-reactivity and/or binding affinity properties of the polyepitopic peptide.

The embodiment of this example provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (excluding an analoged embodiment) directs the immune response to multiple peptide sequences that are actually present in native 193P1E1B, thus avoiding the need to evaluate any junctional epitopes. Lastly, the embodiment provides an economy of scale when producing peptide or nucleic acid vaccine compositions.

Related to this embodiment, computer programs are available in the art which can be used to identify in a target sequence, the greatest number of epitopes per sequence length.

Example 24

Polyepitopic Vaccine Compositions from Multiple Antigens

The 193P1E1B peptide epitopes of the present invention are used in conjunction with epitopes from other target tumor-associated antigens, to create a vaccine composition that is useful for the prevention or treatment of cancer that expresses 193P1E1B and such other antigens. For example, a vaccine composition can be provided as a single polypeptide that incorporates multiple epitopes from 193P1E1B as well as tumor-associated antigens that are often expressed with a target cancer associated with 193P1E1B expression, or can be administered as a composition comprising a cocktail of one or more discrete epitopes. Alternatively, the vaccine can be administered as a minigene construct or as dendritic cells which have been loaded with the peptide epitopes in vitro.

Example 25

Use of Peptides to Evaluate an Immune Response

Peptides of the invention may be used to analyze an immune response for the presence of specific antibodies, CTL or HTL directed to 193P1E1B. Such an analysis can be performed in a manner described by Ogg et al., *Science* 279: 2103-2106, 1998. In this Example, peptides in accordance with the invention are used as a reagent for diagnostic or prognostic purposes, not as an immunogen.

In this example highly sensitive human leukocyte antigen tetrameric complexes ("tetramers") are used for a cross-sectional analysis of, for example, 193P1E1B HLA-A*0201-specific CTL frequencies from HLA A*0201-positive individuals at different stages of disease or following immunization comprising an 193P1E1B peptide containing an A*0201 motif. Tetrameric complexes are synthesized as described (Musey et al., *N. Engl. J. Med.* 337:1267, 1997). Briefly, purified HLA heavy chain (A*0201 in this example) and β2-microglobulin are synthesized by means of a prokaryotic expression system. The heavy chain is modified by deletion of the transmembrane-cytosolic tail and COOH-terminal addition of a sequence containing a BirA enzymatic biotinylation site. The heavy chain, β2-microglobulin, and peptide are refolded by dilution. The 45-kD refolded product is isolated by fast protein liquid chromatography and then biotinylated by BirA in the presence of biotin (Sigma, St. Louis, Mo.), adenosine 5' triphosphate and magnesium. Streptavidin-phycoerythrin conjugate is added in a 1:4 molar ratio, and the tetrameric product is concentrated to 1 mg/ml. The resulting product is referred to as tetramer-phycoerythrin.

For the analysis of patient blood samples, approximately one million PBMCs are centrifuged at 300 g for 5 minutes and resuspended in 50 μl of cold phosphate-buffered saline. Tricolor analysis is performed with the tetramer-phycoerythrin, along with anti-CD8-Tricolor, and anti-CD38. The PBMCs are incubated with tetramer and antibodies on ice for 30 to 60 min and then washed twice before formaldehyde fixation. Gates are applied to contain >99.98% of control samples. Controls for the tetramers include both A*0201-negative individuals and A*0201-positive non-diseased donors. The percentage of cells stained with the tetramer is then determined by flow cytometry. The results indicate the number of cells in the PBMC sample that contain epitope-restricted CTLs, thereby readily indicating the extent of immune response to the 193P1E1B epitope, and thus the status of exposure to 193P1E1B, or exposure to a vaccine that elicits a protective or therapeutic response.

Example 26

Use of Peptide Epitopes to Evaluate Recall Responses

The peptide epitopes of the invention are used as reagents to evaluate T cell responses, such as acute or recall responses, in patients. Such an analysis may be performed on patients who have recovered from 193P1E1B-associated disease or who have been vaccinated with an 193P1E1B vaccine.

For example, the class I restricted CTL response of persons who have been vaccinated may be analyzed. The vaccine may be any 193P1E1B vaccine. PBMC are collected from vaccinated individuals and HLA typed. Appropriate peptide epitopes of the invention that, optimally, bear supermotifs to provide cross-reactivity with multiple HLA supertype family members, are then used for analysis of samples derived from individuals who bear that HLA type.

PBMC from vaccinated individuals are separated on Ficoll-Histopaque density gradients (Sigma Chemical Co., St. Louis, Mo.), washed three times in HBSS (GIBCO Laboratories), resuspended in RPMI-1640 (GIBCO Laboratories) supplemented with L-glutamine (2 mM), penicillin (50U/ml), streptomycin (50 μg/ml), and Hepes (10 mM) containing 10% heat-inactivated human AB serum (complete RPMI) and plated using microculture formats. A synthetic peptide comprising an epitope of the invention is added at 10 μg/ml to each well and HBV core 128-140 epitope is added at 1 μg/ml to each well as a source of T cell help during the first week of stimulation.

In the microculture format, $4 \times 10^5$ PBMC are stimulated with peptide in 8 replicate cultures in 96-well round bottom plate in 100 μl/well of complete RPMI. On days 3 and 10, 100 μl of complete RPMI and 20 U/ml final concentration of rIL-2 are added to each well. On day 7 the cultures are transferred into a 96-well flat-bottom plate and restimulated with peptide, rIL-2 and 105 irradiated (3,000 rad) autologous feeder cells. The cultures are tested for cytotoxic activity on day 14. A positive CTL response requires two or more of the eight replicate cultures to display greater than 10% specific $^{51}$Cr release, based on comparison with non-diseased control subjects as previously described (Rehermann, et al., *Nature Med.* 2:1104,1108, 1996; Rehermann et al., *J. Clin. Invest.* 97:1655-1665, 1996; and Rehermann et al. *J. Clin. Invest.* 98:1432-1440, 1996).

Target cell lines are autologous and allogeneic EBV-transformed B-LCL that are either purchased from the American Society for Histocompatibility and Immunogenetics (ASHI, Boston, Mass.) or established from the pool of patients as described (Guilhot, et al. *J. Virol.* 66:2670-2678, 1992).

Cytotoxicity assays are performed in the following manner. Target cells consist of either allogeneic HLA-matched or autologous EBV-transformed B lymphoblastoid cell line that are incubated overnight with the synthetic peptide epitope of the invention at 10 μM, and labeled with 100 μCi of $^{51}$Cr (Amersham Corp., Arlington Heights, Ill.) for 1 hour after which they are washed four times with HBSS.

Cytolytic activity is determined in a standard 4-h, split well $^{51}$Cr release assay using U-bottomed 96 well plates containing 3,000 targets/well. Stimulated PBMC are tested at effector/target (E/T) ratios of 20-50:1 on day 14. Percent cytotoxicity is determined from the formula: 100×[(experimental release-spontaneous release)/maximum release-spontaneous release)]. Maximum release is determined by lysis of targets by detergent (2% Triton X-100; Sigma Chemical Co., St. Louis, Mo.). Spontaneous release is <25% of maximum release for all experiments.

The results of such an analysis indicate the extent to which HLA-restricted CTL populations have been stimulated by previous exposure to 193P1E1B or an 193P1E1B vaccine.

Similarly, Class II restricted HTL responses may also be analyzed. Purified PBMC are cultured in a 96-well flat bottom plate at a density of $1.5 \times 10^5$ cells/well and are stimulated with 10 μg/ml synthetic peptide of the invention, whole 193P1E1B antigen, or PHA. Cells are routinely plated in replicates of 4-6 wells for each condition. After seven days of culture, the medium is removed and replaced with fresh medium containing 10U/ml IL-2. Two days later, 1 μCi $^3$H-thymidine is added to each well and incubation is continued for an additional 18 hours. Cellular DNA is then harvested on glass fiber mats and analyzed for $^3$H-thymidine incorporation. Antigen-specific T cell proliferation is calculated as the ratio of $^3$H-thymidine incorporation in the presence of antigen divided by the $^3$H-thymidine incorporation in the absence of antigen.

Example 27

Induction of Specific CTL Response in Humans

A human clinical trial for an immunogenic composition comprising CTL and HTL epitopes of the invention is set up as an IND Phase I, dose escalation study and carried out as a randomized, double-blind, placebo-controlled trial. Such a trial is designed, for example, as follows:

A total of about 27 individuals are enrolled and divided into 3 groups:

Group I: 3 subjects are injected with placebo and 6 subjects are injected with 5 μg of peptide composition;

Group II: 3 subjects are injected with placebo and 6 subjects are injected with 50 μg peptide composition;

Group III: 3 subjects are injected with placebo and 6 subjects are injected with 500 μg of peptide composition.

After 4 weeks following the first injection, all subjects receive a booster inoculation at the same dosage.

The endpoints measured in this study relate to the safety and tolerability of the peptide composition as well as its immunogenicity. Cellular immune responses to the peptide composition are an index of the intrinsic activity of this the peptide composition, and can therefore be viewed as a measure of biological efficacy. The following summarize the clinical and laboratory data that relate to safety and efficacy endpoints.

Safety: The incidence of adverse events is monitored in the placebo and drug treatment group and assessed in terms of degree and reversibility.

Evaluation of Vaccine Efficacy: For evaluation of vaccine efficacy, subjects are bled before and after injection. Peripheral blood mononuclear cells are isolated from fresh heparinized blood by Ficoll-Hypaque density gradient centrifugation, aliquoted in freezing media and stored frozen. Samples are assayed for CTL and HTL activity.

The vaccine is found to be both safe and efficacious.

Example 28

Phase II Trials in Patients Expressing 193P1E1B

Phase II trials are performed to study the effect of administering the CTL-HTL peptide compositions to patients having cancer that expresses 193P1E1B. The main objectives of the trial are to determine an effective dose and regimen for inducing CTLs in cancer patients that express 193P1E1B, to establish the safety of inducing a CTL and HTL response in these patients, and to see to what extent activation of CTLs improves the clinical picture of these patients, as manifested, e.g., by the reduction and/or shrinking of lesions. Such a study is designed, for example, as follows:

The studies are performed in multiple centers. The trial design is an open-label, uncontrolled, dose escalation protocol wherein the peptide composition is administered as a single dose followed six weeks later by a single booster shot of the same dose. The dosages are 50, 500 and 5,000 micrograms per injection. Drug-associated adverse effects (severity and reversibility) are recorded.

There are three patient groupings. The first group is injected with 50 micrograms of the peptide composition and the second and third groups with 500 and 5,000 micrograms of peptide composition, respectively. The patients within each group range in age from 21-65 and represent diverse ethnic backgrounds. All of them have a tumor that expresses 193P1E1B.

Clinical manifestations or antigen-specific T-cell responses are monitored to assess the effects of administering the peptide compositions. The vaccine composition is found to be both safe and efficacious in the treatment of 193P1E1B-associated disease.

Example 29

Induction of CTL Responses Using a Prime Boost Protocol

A prime boost protocol similar in its underlying principle to that used to confirm the efficacy of a DNA vaccine in transgenic mice, such as described above in the Example entitled "The Plasmid Construct and the Degree to Which It Induces Immunogenicity," can also be used for the administration of the vaccine to humans. Such a vaccine regimen can include an initial administration of, for example, naked DNA followed by a boost using recombinant virus encoding the vaccine, or recombinant protein/polypeptide or a peptide mixture administered in an adjuvant.

For example, the initial immunization may be performed using an expression vector, such as that constructed in the Example entitled "Construction of 'Minigene' Multi-Epitope DNA Plasmids" in the form of naked nucleic acid administered IM (or SC or ID) in the amounts of 0.5-5 mg at multiple sites. The nucleic acid (0.1 to 1000 µg) can also be administered using a gene gun. Following an incubation period of 3-4 weeks, a booster dose is then administered. The booster can be recombinant fowlpox virus administered at a dose of $5\text{-}10^7$ to $5 \times 10^9$ pfu. An alternative recombinant virus, such as an MVA, canarypox, adenovirus, or adeno-associated virus, can also be used for the booster, or the polyepitopic protein or a mixture of the peptides can be administered. For evaluation of vaccine efficacy, patient blood samples are obtained before immunization as well as at intervals following administration of the initial vaccine and booster doses of the vaccine. Peripheral blood mononuclear cells are isolated from fresh heparinized blood by Ficoll-Hypaque density gradient centrifugation, aliquoted in freezing media and stored frozen. Samples are assayed for CTL and HTL activity.

Analysis of the results indicates that a magnitude of response sufficient to achieve a therapeutic or protective immunity against 193P1E1B is generated.

Example 30

Administration of Vaccine Compositions Using Dendritic Cells (DC)

Vaccines comprising peptide epitopes of the invention can be administered using APCs, or "professional" APCs such as DC. In this example, peptide-pulsed DC are administered to a patient to stimulate a CTL response in vivo. In this method, dendritic cells are isolated, expanded, and pulsed with a vaccine comprising peptide CTL and HTL epitopes of the invention. The dendritic cells are infused back into the patient to elicit CTL and HTL responses in vivo. The induced CTL and HTL then destroy or facilitate destruction, respectively, of the target cells that bear the 193P1 µl B protein from which the epitopes in the vaccine are derived.

For example, a cocktail of epitope-comprising peptides is administered ex vivo to PBMC, or isolated DC therefrom. A pharmaceutical to facilitate harvesting of DC can be used, such as Progenipoietin™ (Monsanto, St. Louis, Mo.) or GM-CSF/IL-4. After pulsing the DC with peptides, and prior to reinfusion into patients, the DC are washed to remove unbound peptides.

As appreciated clinically, and readily determined by one of skill based on clinical outcomes, the number of DC reinfused into the patient can vary (see, e.g., *Nature Med.* 4:328, 1998; *Nature Med.* 2:52, 1996 and *Prostate* 32:272, 1997). Although $2\text{-}50 \times 10^6$ DC per patient are typically administered, larger number of DC, such as $10^7$ or $10^8$ can also be provided. Such cell populations typically contain between 50-90% DC.

In some embodiments, peptide-loaded PBMC are injected into patients without purification of the DC. For example, PBMC generated after treatment with an agent such as Progenipoietin™ are injected into patients without purification of the DC. The total number of PBMC that are administered often ranges from $10^8$ to $10^{10}$. Generally, the cell doses injected into patients is based on the percentage of DC in the blood of each patient, as determined, for example, by immunofluorescence analysis with specific anti-DC antibodies.

Thus, for example, if Progenipoietin™ mobilizes 2% DC in the peripheral blood of a given patient, and that patient is to receive $5 \times 10^6$ DC, then the patient will be injected with a total of $2.5 \times 10^8$ peptide-loaded PBMC. The percent DC mobilized by an agent such as Progenipoietin™ is typically estimated to be between 2-10%, but can vary as appreciated by one of skill in the art.

Ex Vivo Activation of CTL/HTL Responses

Alternatively, ex vivo CTL or HTL responses to 193P1E1B antigens can be induced by incubating, in tissue culture, the patient's, or genetically compatible, CTL or HTL precursor cells together with a source of APC, such as DC, and immunogenic peptides. After an appropriate incubation time (typically about 7-28 days), in which the precursor cells are activated and expanded into effector cells, the cells are infused into the patient, where they will destroy (CTL) or facilitate destruction (HTL) of their specific target cells, i.e., tumor cells.

Example 31

An Alternative Method of Identifying and Confirming Motif-Bearing Peptides

Another method of identifying and confirming motif-bearing peptides is to elute them from cells bearing defined MHC molecules. For example, EBV transformed B cell lines used for tissue typing have been extensively characterized to determine which HLA molecules they express. In certain cases these cells express only a single type of HLA molecule. These cells can be transfected with nucleic acids that express the antigen of interest, e.g. 193P1E1B. Peptides produced by endogenous antigen processing of peptides produced as a result of transfection will then bind to HLA molecules within the cell and be transported and displayed on the cell's surface. Peptides are then eluted from the HLA molecules by exposure to mild acid conditions and their amino acid sequence determined, e.g., by mass spectral analysis (e.g., Kubo et al., *J. Immunol.* 152:3913, 1994). Because the majority of peptides that bind a particular HLA molecule are motif-bearing, this is an alternative modality for obtaining the motif-bearing peptides correlated with the particular HLA molecule expressed on the cell.

Alternatively, cell lines that do not express endogenous HLA molecules can be transfected with an expression construct encoding a single HLA allele. These cells can then be used as described, i.e., they can then be transfected with nucleic acids that encode 193P1E1B to isolate peptides corresponding to 193P1E1B that have been presented on the cell surface. Peptides obtained from such an analysis will bear motif(s) that correspond to binding to the single HLA allele that is expressed in the cell.

As appreciated by one in the art, one can perform a similar analysis on a cell bearing more than one HLA allele and subsequently determine peptides specific for each HLA allele expressed. Moreover, one of skill would also recognize that means other than transfection, such as loading with a protein antigen, can be used to provide a source of antigen to the cell.

Example 32

Complementary Polynucleotides

Sequences complementary to the 193P1E1B-encoding sequences, or any parts thereof, are used to detect, decrease, or inhibit expression of naturally occurring 193P1E1B. Although use of oligonucleotides comprising from about 15 to 30 base pairs is described, essentially the same procedure is used with smaller or with larger sequence fragments. Appropriate oligonucleotides are designed using, e.g., OLIGO 4.06 software (National Biosciences) and the coding sequence of 193P1E1B. To inhibit transcription, a complementary oligonucleotide is designed from the most unique 5' sequence and used to prevent promoter binding to the coding sequence. To inhibit translation, a complementary oligonucleotide is designed to prevent ribosomal binding to a 193P1E1B-encoding transcript.

Example 33

Purification of Naturally-occurring or Recombinant 193P1E1B Using 193P1E1B Specific Antibodies Naturally occurring or recombinant 193P1E1B is substantially purified by immunoaffinity chromatography using antibodies specific for 193P1E1B. An immunoaffinity column is constructed by covalently coupling anti-193P1E1B antibody to an activated chromatographic resin, such as CNBr-activated SEPHAROSE (Amersham Pharmacia Biotech). After the coupling, the resin is blocked and washed according to the manufacturer's instructions.

Media containing 193P1E1B are passed over the immunoaffinity column, and the column is washed under conditions that allow the preferential absorbance of 193P1E1B (e.g., high ionic strength buffers in the presence of detergent). The column is eluted under conditions that disrupt antibody/193P1E1B binding (e.g., a buffer of pH 2 to pH 3, or a high concentration of a chaotrope, such as urea or thiocyanate ion), and GCR.P is collected.

Example 34

Identification of Molecules which Interact with 193P1E1B

193P1E1B, or biologically active fragments thereof, are labeled with 121 1 Bolton-Hunter reagent. (See, e.g., Bolton et al. (1973) Biochem. J. 133:529.) Candidate molecules previously arrayed in the wells of a multi-well plate are incubated with the labeled 193P1E1B, washed, and any wells with labeled 193P1E1B complex are assayed. Data obtained using different concentrations of 193P1E1B are used to calculate values for the number, affinity, and association of 193P1E1B with the candidate molecules.

Example 35

In Vivo Assay for 193P1E1B Tumor Growth Promotion

The effect of a 193P1E1B protein on tumor cell growth can be confirmed in vivo by gene overexpression in a variety of cancer cells such as those in Table I, including prostate, kidney, colon and bladder. For example, SCID mice can be injected SQ on each flank with $1 \times 10^6$ prostate, kidney, colon or bladder cancer cells (such as PC3, LNCaP, SCaBER, UM-UC-3, HT1376, SK-CO, Caco, RT4, T24, Caki, A-498 and SW839 cells) containing tkNeo empty vector or 193P1E1B.

At least two strategies can be used:

(1) Constitutive 193P1E1B expression under regulation of a promoter such as a constitutive promoter obtained from the genomes of viruses such as polyoma virus, fowlpox virus (UK 2,211,504 published Jul. 5, 1989), adenovirus (such as Adenovirus 2), bovine papilloma virus, avian sarcoma virus, cytomegalovirus, a retrovirus, hepatitis-B virus and Simian Virus 40 (SV40), or from heterologous mammalian promoters, e.g., the actin promoter or an immunoglobulin promoter, provided such promoters are compatible with the host cell systems.

(2) Regulated expression under control of an inducible vector system, such as ecdysone, tet, etc., can be used provided such promoters are compatible with the host cell systems. Tumor volume is then monitored at the appearance of palpable tumors or by following serum markers such as PSA. Tumor development is followed over time to validate that 193P1E1B-expressing cells grow at a faster rate and/or that tumors produced by 193P1E1B-expressing cells demonstrate characteristics of altered aggressiveness (e.g., enhanced metastasis, vascularization, reduced responsiveness to chemotherapeutic drugs). Tumor volume is evaluated by caliper measurements. Additionally, mice can be implanted with the same cells orthotopically in the prostate, bladder, colon or kidney to determine if 193P1E1B has an effect on local growth, e.g., in the prostate, bladder, colon or kidney or on the ability of the cells to metastasize, specifically to lungs or lymph nodes (Saffran et al., Proc Natl Acad Sci USA. 2001, 98: 2658; Fu, X., et al., Int. J. Cancer, 1991. 49: 938-939; Chang, S., et al., Anticancer Res., 1997, 17: 3239-3242; Peralta, E. A., et al., J. Urol., 1999. 162: 1806-1811). For instance, the orthotopic growth of PC3 and PC3-193P1E1B can be compared in the prostate of SCID mice. Such experiments reveal the effect of 193P1E1B on orthotopic tumor growth, metastasis and/or angiogenic potential.

Furthermore, this assay is useful to confirm the inhibitory effect of candidate therapeutic compositions, such as for example, 193P1E1B antibodies or intrabodies, and 193P1E1B antisense molecules or ribozymes, or 193P1E1B directed small molecules, on cells that express a 193P1E1B protein.

Example 36

193P1E1B Monoclonal Antibody-mediated Inhibition of Human Xenograft Tumors in vivo The significant expression of 193P1E1B, in cancer tissues, together with its restricted expression in normal tissues along with its cell surface expression makes 193P1E1B an excellent target for antibody therapy. Similarly, 193P1E1B is a target for T cell-based immunotherapy. Thus, the therapeutic efficacy of anti-193P1E1B mAbs is evaluated, e.g., in human prostate cancer xenograft mouse models using androgen-independent LAPC-4 and LAPC-9 xenografts (Craft, N., et al., Cancer Res, 1999. 59(19): p. 5030-5036), kidney cancer xenografts (AGS-K3, AGS-K6), kidney cancer metastases to lymph node (AGS-K6 met) xenografts, and kidney cancer cell lines transfected with 193P1E1B, such as 769P-193P1E1B, A498-193P1E1B.

Antibody efficacy on tumor growth and metastasis formation is studied, e.g., in mouse subcutaneous or orthotopic prostate cancer xenograft models and mouse kidney xenograft models. The antibodies can be unconjugated, as discussed in this Example, or can be conjugated to a therapeutic modality, as appreciated in the art. Anti-193P1E1B mAbs inhibit formation of both the androgen-dependent LAPC-9 and androgen-independent PC3-193 P1 E1B tumor xenografts. Anti-193P1E1B mAbs also retard the growth of established orthotopic tumors and prolonged survival of tumor-bearing mice. These results indicate the utility of anti-193P1E1B mAbs in the treatment of local and advanced stages of, e.g., prostate cancer. (See, e.g., Saffran, D., et al., PNAS 10:1073-1078). Similarly, anti-193P1E1B mAbs inhibit formation of AGS-K3 and AGS-K6 tumors in SCID mice, and prevent or retard the growth A498-193P1E1B tumor xenografts. These results indicate the use of anti-193P1E1B mAbs in the treatment of prostate and/or kidney cancer.

Administrati

You et al., Neoplasia. Jun. 2007; 9(6): 464-470.*

International Search Report for PCT/US02/39274, mailed on Oct. 6, 2004, 3 pages.

Ota et al., Nat. Genet. (2004) 36(1):40-45.

Shibata et al., Genome Res. (2000) 10(11):1757-1771.

Thai et al., Adv. Immunol. (2005) 86:113-136 (abstract only).

Greenbaum et al., Genome Biology (2003) 4(9):117.1-117.8.

Database EMBL, EBI accession No. EMBL:BC013418 (2001).

Database EMBL, EBI accession No. EMBL:BG392826 (2001).

Database EMBL, EBI accession No. EMBL:AL561096 (2001).

Database EMBL, EBI accession No. EMBL:AL519504 (2001).

Database EMBL, EBI accession No. EMBL:AK090584 (2002).

Supplementary Partial European Search Report for EP 02797238.9, mailed Oct. 12, 2007, 7 pages.

Hubert et al., PNAS USA (1999) 96(25):14523-14528.

Japanese Office Action for Application No. 2003-551277, mailed on Feb. 15, 2008, 7 pages.

Klein et al., Nature Medicine (1997) 3(4):402-408.

* cited by examiner

You et al., Neoplasia. Jun. 2007; 9(6): 464-470.*

International Search Report for PCT/US02/39274, mailed on Oct. 6, 2004, 3 pages.

Ota et al., Nat. Genet. (2004) 36(1):40-45.

Shibata et al., Genome Res. (2000) 10(11):1757-1771.

Thai et al., Adv. Immunol. (2005) 86:113-136 (abstract only).

Greenbaum et al., Genome Biology (2003) 4(9):117.1-117.8.

Database EMBL, EBI accession No. EMBL:BC013418 (2001).

Database EMBL, EBI accession No. EMBL:BG392826 (2001).

Database EMBL, EBI accession No. EMBL:AL561096 (2001).

Database EMBL, EBI accession No. EMBL:AL519504 (2001).

Database EMBL, EBI accession No. EMBL:AK090584 (2002).

Supplementary Partial European Search Report for EP 02797238.9, mailed Oct. 12, 2007, 7 pages.

Hubert et al., PNAS USA (1999) 96(25):14523-14528.

Japanese Office Action for Application No. 2003-551277, mailed on Feb. 15, 2008, 7 pages.

Klein et al., Nature Medicine (1997) 3(4):402-408.

* cited by examiner on of the anti-193P1E1B mAbs leads to retardation of established orthotopic tumor growth and inhibition of metastasis to distant sites, resulting in a significant prolongation in the survival of tumor-bearing mice. These studies indicate that 193P1E1B is an attractive target for immunotherapy and demonstrate the therapeutic use of anti-193P1E1B mAbs for the treatment of local and metastatic cancer. This example demonstrates that unconjugated 193P1E1B monoclonal antibodies are effective to inhibit the growth of human prostate tumor xenografts and human kidney xenografts grown in SCID mice.

Tumor Inhibition Using Multiple Unconjugated 193P1E1B mAbs

Materials and Methods

193P1E1B Monoclonal Antibodies:

Monoclonal antibodies are obtained against 193P1E1B, such as described in the Example entitled "Generation of 193P1E1B Monoclonal Antibodies (mAbs)" or may be obtained commercially. The antibodies are characterized by ELISA, Western blot, FACS, and immunoprecipitation for their capacity to bind 193P1E1B. Epitope mapping data for the anti-193P1E1B mAbs, as determined by ELISA and Western analysis, recognize epitopes on a 193P1E1B protein. Immunohistochemical analysis of cancer tissues and cells is performed with these antibodies.

The monoclonal antibodies are purified from ascites or hybridoma tissue culture supernatants by Protein-G Sepharose chromatography, dialyzed against PBS, filter sterilized, and stored at $-20°$ C. Protein determinations are performed by a Bradford assay (Bio-Rad, Hercules, Calif.). A therapeutic monoclonal antibody or a cocktail comprising a mixture of individual monoclonal antibodies is prepared and used for the treatment of mice receiving subcutaneous or orthotopic injections of, e.g., LAPC-9 prostate tumor xenografts.

Cancer Xenografts and Cell Lines

The LAPC-9 xenograft, which expresses a wild-type androgen receptor and produces prostate-specific antigen (PSA), is passaged in 6- to 8-week-old male ICR-severe combined immunodeficient (SCID) mice (Taconic Farms) by s.c. trocar implant (Craft, N., et al., 1999, Cancer Res. 59:5030-5036). The AGS-K3 and AGS-K6 kidney xenografts are also passaged by subcutaneous implants in 6- to 8-week old SCID mice. Single-cell suspensions of tumor cells are prepared as described in Craft, et al. The prostate carcinoma cell line PC3 (American Type Culture Collection) is maintained in RPMI supplemented with L-glutamine and 10% FBS, and the kidney carcinoma line A498 (American Type Culture Collection) is maintained in DMEM supplemented with L-glutamine and 10% FBS.

PC3-193P1E1B and A498-193P1E1B cell populations are generated by retroviral gene transfer as described in Hubert, R. S., et al., STEAP: A Prostate-specific Cell-surface Antigen Highly Expressed in Human Prostate Tumors, Proc Natl Acad Sci USA, 1999. 96(25): p. 14523-14528. Anti-193P1E1B staining is detected by using, e.g., an FITC-conjugated goat anti-mouse antibody (Southern Biotechnology Associates) followed by analysis on a Coulter Epics-XL flow cytometer.

Xenograft Mouse Models.

Subcutaneous (s.c.) tumors are generated by injection of $1×10^6$ LAPC-9, AGS-K3, AGS-K6, PC3, PC3-193P1E1B, A498 or A498-193P1E1B cells mixed at a 1:1 dilution with Matrigel (Collaborative Research) in the right flank of male SCID mice. To test antibody efficacy on tumor formation, i.p. antibody injections are started on the same day as tumor-cell injections. As a control, mice are injected with either purified mouse IgG (ICN) or PBS; or a purified monoclonal antibody that recognizes an irrelevant antigen not expressed in human cells. In preliminary studies, no difference is found between mouse IgG or PBS on tumor growth. Tumor sizes are determined by vernier caliper measurements, and the tumor volume is calculated as length×width×height. Mice with s.c. tumors greater than 1.5 cm in diameter are sacrificed. PSA levels are determined by using a PSA ELISA kit (Anogen, Mississauga, Ontario). Circulating levels of anti-193P1E1B mAbs are determined by a capture ELISA kit (Bethyl Laboratories, Montgomery, Tex.). (See, e.g., (Saffran, D., et al., PNAS 10:1073-1078)

Orthotopic prostate injections are performed under anesthesia by using ketamine/xylazine. For prostate orthotopic studies, an incision is made through the abdominal muscles to expose the bladder and seminal vesicles, which then are delivered through the incision to expose the dorsal prostate. LAPC-9 cells ($5×10^5$) mixed with Matrigel are injected into each dorsal lobe in a 10 µl volume. To monitor tumor growth, mice are bled on a weekly basis for determination of PSA levels. For kidney orthopotic models, an incision is made through the abdominal muscles to expose the kidney. AGS-K3 or AGS-K6 cells mixed with Matrigel are injected under the kidney capsule. The mice are segregated into groups for appropriate treatments, with anti-193P1E1B or control mAbs being injected i.p.

Anti-193P1E1B mAbs Inhibit Growth of 193P1E1B-Expressing Xenograft-Cancer Tumors The effect of anti-193P1E1B mAbs on tumor formation is tested by using orthotopic models, e.g., LAPC-9 and/or AGS-K3 orthotopic models. As compared with the s.c. tumor model, the orthotopic model, which requires injection of tumor cells directly in the mouse prostate or kidney, respectively, results in a local tumor growth, development of metastasis in distal sites, deterioration of mouse health, and subsequent death (Saffran, D., et al., PNAS supra; Fu, X., et al., Int J Cancer, 1992. 52(6): p. 987-90; Kubota, T., J Cell Biochem, 1994. 56(1): p. 4-8). The features make the orthotopic model more representative of human disease progression and allow for tracking of the therapeutic effect of mAbs on clinically relevant end points.

Accordingly, tumor cells are injected into the mouse prostate or kidney, and the mice are segregated into two groups and treated with either: a) 200-500%g, of anti-193P1E1B Ab, b) PBS or c) control non-specific monoclonal antibody for two to five weeks.

As noted, a major advantage of the orthotopic prostate-cancer model is the ability to study the development of metastases. Formation of metastasis in mice bearing established orthotopic tumors is studied by IHC analysis on lung sections using an antibody against a prostate-specific cell-surface protein STEAP expressed at high levels in LAPC-9 xenografts (Hubert, R. S., et al., Proc Natl Acad Sci USA, 1999. 96(25): p. 14523-14528) or anti-G250 antibody for kidney cancer models. G250 is a clinically relevant marker for renal clear cell carcinoma, which is selectively expressed on tumor but not normal kidney cells (Grabmaier K et al, Int J Cancer. 2000, 85:865).

Mice bearing established orthotopic LAPC-9 tumors are administered one to three injections per week of 500-1000 µg of either anti-193P1E1B mAb, control antibody or PBS two- to three times per week over a 4-8 week period. Mice in both groups are allowed to establish a high tumor burden (PSA levels greater than 300 ng/ml), to ensure a high frequency of metastasis formation in mouse lungs. Mice then are killed and their prostate/kidney and lungs are analyzed for the presence of tumor cells by IHC analysis.

These studies demonstrate a broad anti-tumor efficacy of anti-193P1E1B antibodies on initiation and/or progression of prostate and kidney cancer in xenograft mouse models. Anti-193P1E1B antibodies inhibit tumor formation of both androgen-dependent and androgen-independent prostate tumors as well as retarding the growth of already established tumors and prolong the survival of treated mice. Moreover, anti-193P1E1B mAbs demonstrate a dramatic inhibitory effect on the spread of local prostate tumor to distal sites, even in the presence of a large tumor burden. Similar therapeutic effects are seen in the kidney cancer model. Thus, anti-193P1E1B mAbs are efficacious on major clinically relevant end points (tumor growth), prolongation of survival, and health.

Example 37

Therapeutic and Diagnostic Use of Anti-193P1E1B Antibodies in Humans

Anti-193P1E1B monoclonal antibodies are safely and effectively used for diagnostic, prophylactic, prognostic and/or therapeutic purposes in humans. Western blot and immunohistochemical analysis of cancer tissues and cancer xenografts with anti-193P1E1B mAb show strong extensive staining in carcinoma but significantly lower or undetectable levels in normal tissues. Detection of 193P1E1B in carcinoma and in metastatic disease demonstrates the usefulness of the mAb as a diagnostic and/or prognostic indicator. Anti-193P1E1B antibodies are therefore used in diagnostic applications such as immunohistochemistry of kidney biopsy specimens to detect cancer from suspect patients.

As determined by flow cytometry, anti-193P1E1B mAb specifically binds to carcinoma cells. Thus, anti-193P1E1B antibodies are used in diagnostic whole body imaging applications, such as radioimmunoscintigraphy and radioimmunotherapy, (see, e.g., Potamianos S., et. al. Anticancer Res 20(2A):925-948 (2000)) for the detection of localized and metastatic cancers that exhibit expression of 193P1E1B. Shedding or release of an extracellular domain of 193P1E1B into the extracellular milieu, such as that seen for alkaline phosphodiesterase B10 (Meerson, N. R., Hepatology 27:563-568 (1998)), allows diagnostic detection of 193P1E1B by anti-193P1E1B antibodies in serum and/or urine samples from suspect patients.

Anti-193P1E1B antibodies that specifically bind 193P1E1B are used in therapeutic applications for the treatment of cancers that express 193P1E1B. Anti-193P1E1B antibodies are used as an unconjugated modality and as conjugated form in which the antibodies are attached to one of various therapeutic or imaging modalities well known in the art, such as a prodrugs, enzymes or radioisotopes. In preclinical studies, unconjugated and conjugated anti-193P1E1B antibodies are tested for efficacy of tumor prevention and growth inhibition in the SCID mouse cancer xenograft models, e.g., kidney cancer models AGS-K3 and AGS-K6, (see, e.g., the Example entitled "Monoclonal Antibody-mediated Inhibition of Prostate and Kidney Tumors In vivo." Conjugated and unconjugated anti-193P1E1B antibodies are used as a therapeutic modality in human clinical trials either alone or in combination with other treatments as described in following Examples.

Example 38

Human Clinical Trials for the Treatment and Diagnosis of Human Carcinomas through Use of Human Anti-193P1E1B Antibodies in vivo Antibodies are used in accordance with the present invention which recognize an epitope on 193P1E1B, and are used in the treatment of certain tumors such as those listed in Table I. Based upon a number of factors, including 193P1E1B expression levels, tumors such as those listed in Table I are presently preferred indications. In connection with each of these indications, three clinical approaches are successfully pursued.

I.) Adjunctive therapy: In adjunctive therapy, patients are treated with anti-193P1E1B antibodies in combination with a chemotherapeutic or antineoplastic agent and/or radiation therapy. Primary cancer targets, such as those listed in Table I, are treated under standard protocols by the addition anti-193P1E1B antibodies to standard first and second line therapy. Protocol designs address effectiveness as assessed by reduction in tumor mass as well as the ability to reduce usual doses of standard chemotherapy. These dosage reductions allow additional and/or prolonged therapy by reducing dose-related toxicity of the chemotherapeutic agent. Anti-193P1E1B antibodies are utilized in several adjunctive clinical trials in combination with the chemotherapeutic or antineoplastic agents adriamycin (advanced prostate carcinoma), cisplatin (advanced head and neck and lung carcinomas), taxol (breast cancer), and doxorubicin (preclinical).

II.) Monotherapy: In connection with the use of the anti-193P1E1B antibodies in monotherapy of tumors, the antibodies are administered to patients without a chemotherapeutic or antineoplastic agent. In one embodiment, monotherapy is conducted clinically in end stage cancer patients with extensive metastatic disease. Patients show some disease stabilization. Trials demonstrate an effect in refractory patients with cancerous tumors.

III.) Imaging Agent: Through binding a radionuclide (e.g., iodine or yttrium ($I^{131}$, $Y^{90}$) to anti-193P1E1B antibodies, the radiolabeled antibodies are utilized as a diagnostic and/or imaging agent. In such a role, the labeled antibodies localize to both solid tumors, as well as, metastatic lesions of cells expressing 193P1E1B. In connection with the use of the anti-193P1E1B antibodies as imaging agents, the antibodies are used as an adjunct to surgical treatment of solid tumors, as both a pre-surgical screen as well as a post-operative follow-up to determine what tumor remains and/or returns. In one embodiment, a ($^{111}$In)-193P1E1B antibody is used as an imaging agent in a Phase I human clinical trial in patients having a carcinoma that expresses 193P1E1B (by analogy see, e.g., Divgi et al. *J. Natl. Cancer Inst.* 83:97-104 (1991)). Patients are followed with standard anterior and posterior gamma camera. The results indicate that primary lesions and metastatic lesions are identified Dose and Route of Administration As appreciated by those of ordinary skill in the art, dosing considerations can be determined through comparison with the analogous products that are in the clinic. Thus, anti-193P1E1B antibodies can be administered with doses in the range of 5 to 400 mg/m$^2$, with the lower doses used, e.g., in connection with safety studies. The affinity of anti-193P1E1B antibodies relative to the affinity of a known antibody for its target is one parameter used by those of skill in the art for determining analogous dose regimens. Further, anti-193P1E1B antibodies that are fully human antibodies, as compared to the chimeric antibody, have slower clearance; accordingly, dosing in patients with such fully human anti-193P1E1B antibodies can be lower, perhaps in the range of 50 to 300 mg/m$^2$, and still remain efficacious. Dosing in mg/m$^2$, as opposed to the conventional measurement of dose in mg/kg, is a measurement based on surface area and is a convenient dosing measurement that is designed to include patients of all sizes from infants to adults.

Three distinct delivery approaches are useful for delivery of anti-193P1E1B antibodies. Conventional intravenous delivery is one standard delivery technique for many tumors. However, in connection with tumors in the peritoneal cavity, such as tumors of the ovaries, biliary duct, other ducts, and the like, intraperitoneal administration may prove favorable for obtaining high dose of antibody at the tumor and to also minimize antibody clearance. In a similar manner, certain solid tumors possess vasculature that is appropriate for regional perfusion. Regional perfusion allows for a high dose of antibody at the site of a tumor and minimizes short term clearance of the antibody.

Clinical Development Plan (CDP)

Overview: The CDP follows and develops treatments of anti-193P1E1B antibodies in connection with adjunctive therapy, monotherapy, and as an imaging agent. Trials initially demonstrate safety and thereafter confirm efficacy in repeat doses. Trails are open label comparing standard chemotherapy with standard therapy plus anti-193P1E1B antibodies. As will be appreciated, one criteria that can be utilized in connection with enrollment of patients is 193P1E1B expression levels in their tumors as determined by biopsy.

As with any protein or antibody infusion-based therapeutic, safety concerns are related primarily to (i) cytokine release syndrome, i.e., hypotension, fever, shaking, chills; (ii) the development of an immunogenic response to the material (i.e., development of human antibodies by the patient to the antibody therapeutic, or HAHA response); and, (iii) toxicity to normal cells that express 193P1E1B. Standard tests and follow-up are utilized to monitor each of these safety concerns. Anti-193P1E1B antibodies are found to be safe upon human administration.

Example 39

Human Clinical Trial Adjunctive Therapy with Human Anti-193P1E1B Antibody and Chemotherapeutic Agent A phase I human clinical trial is initiated to assess the safety of six intravenous doses of a human anti-193P1E1B antibody in connection with the treatment of a solid tumor, e.g., a cancer of a tissue listed in Table I. In the study, the safety of single doses of anti-193P1E1B antibodies when utilized as an adjunctive therapy to an antineoplastic or chemotherapeutic agent, such as cisplatin, topotecan, doxorubicin, adriamycin, taxol, or the like, is assessed. The trial design includes delivery of six single doses of an anti-193P1E1B antibody with dosage of antibody escalating from approximately about 25 mg/m$^2$ to about 275 mg/m$^2$ over the course of the treatment in accordance with the following schedule:

|  | Day 0 | Day 7 | Day 14 | Day 21 | Day 28 | Day 35 |
| --- | --- | --- | --- | --- | --- | --- |
| mAb Dose | 25 mg/m$^2$ | 75 mg/m$^2$ | 125 mg/m$^2$ | 175 mg/m$^2$ | 225 mg/m$^2$ | 275 mg/m$^2$ |
| Chemotherapy (standard dose) | + | + | + | + | + | + |

Patients are closely followed for one-week following each administration of antibody and chemotherapy. In particular, patients are assessed for the safety concerns mentioned above: (i) cytokine release syndrome, i.e., hypotension, fever, shaking, chills; (ii) the development of an immunogenic response to the material (i.e., development of human antibodies by the patient to the human antibody therapeutic, or HAHA response); and, (iii) toxicity to normal cells that express 193P1E1B. Standard tests and follow-up are utilized to monitor each of these safety concerns. Patients are also assessed for clinical outcome, and particularly reduction in tumor mass as evidenced by MRI or other imaging.

The anti-193P1E1B antibodies are demonstrated to be safe and efficacious, Phase II trials confirm the efficacy and refine optimum dosing.

Example 40

Human Clinical Trial: Monotherapy with Human Anti-193P1E1B Antibody

Anti-193P1E1B antibodies are safe in connection with the above-discussed adjunctive trial, a Phase II human clinical trial confirms the efficacy and optimum dosing for monotherapy. Such trial is accomplished, and entails the same safety and outcome analyses, to the above-described adjunctive trial with the exception being that patients do not receive chemotherapy concurrently with the receipt of doses of anti-193P1E1B antibodies.

Example 41

Human Clinical Trial: Diagnostic Imaging with Anti-193P1E1B Antibody

Once again, as the adjunctive therapy discussed above is safe within the safety criteria discussed above, a human clinical trial is conducted concerning the use of anti-193P1E1B antibodies as a diagnostic imaging agent. The protocol is designed in a substantially similar manner to those described in the art, such as in Divgi et al. *J. Natl. Cancer Inst.* 83:97-104 (1991). The antibodies are found to be both safe and efficacious when used as a diagnostic modality.

Example 42

Homology Comparison of 193P1E1B to Known Sequences

The 193P1E1B protein has several variant forms (FIG. 4; FIG. 19). Two variants, 193P1E1B v.1 and 193P1E1B v.2, consist of 412 amino acids each, with calculated molecular weight of 46.25 kDa, and pI of 5.18. 193P1E1B v.3 has an 82 amino acid deletion at the amino terminus, resulting in a protein of 330 amino acids, with calculated molecular weight of 36.9 kDa, and pI of 5.03. Due to the amino terminal truncation, 193P1E1B v.3 has altered amino acid sequence relative to 193P1E1B v.1 and v.2. Variants 1-6 of 193P1E1B are each predicted to be nuclear proteins. Motif analysis did not reveal known motifs.

Several variant forms of 193P1E1B show homology to a human unknown protein (AAH13418); 193P1E1Bv.1 shares 99% identity and 99% homology with that protein over 330 out of 412 aa, while 193P1E1Bv.2 share 100% identity and 100% homology over 330 out of 412 aa (FIG. 20). 193P1E1Bv.3 demonstrates 100% identity with AAH13418 over 330 of 330 aa, 193P1E1Bv.4 and 193P1E1Bv.5 show 100% identity with AAH13418 over 291 of 388 and 306aa respectively, while 193P1E1Bv.6 shows 100% identity over only 39 aa (FIG. 20).

Several forms of 193P1E1B also exhibit some homology to double-stranded RNA-specific adenosine deaminase (DRADA) (P55265). 193P1E1Bv.1 and 193P1E1Bv.2 share 23% identity and 36% homology with DRADA (FIG. 18).

Similar results were obtained with 193P1E1Bv.3, 193P1E1Bv.4 and 193P1E1Bv.5 (not shown). 193P1E1B v.1-v.5 align with the double-stranded RNA-specific adenosine deaminase between aa 123 and 486 of that protein, a region where two adenosine deaminase z-alpha domains and one Double-stranded RNA binding motifs are located. This indicates that 193P1E1B has the ability to bind specifically to double stranded RNA or DNA (Schwartz T., et al., Nature Struc. Biol. 2001, 8:761).

Adenosine deaminases acting on RNA have been shown to be involved in RNA editing (Raitskin, O., et al., Proc. Natl. Acad. Sci 2001, 98:6571). Recent studies have associated adenosine deaminase with cancer and cellular proliferation (Eroglu A, et al., Med Oncol. 2000, 17:319-24; Barry C.P., and, Lind, S.E., Cancer Res. 2000, 60:1887-94). In addition, adenosine deaminase is highly expressed in tumor tissue relative to normal tissues in such cancers as colon, leukemia and other lymphoid cancers (Blatt, J., et al., N Engl J. Med. 1980; 303:918; Eroglu, A., et al., Med Oncol. 2000, 17:319). Adenosine deaminase has been considered a potential marker for lymphoid malignancies (Blatt J et al., N Engl J. Med. 1980;303:918). In addition, inhibition of adenosine deaminase was found to result in cell death of epithelial cells (Barry, C. P., and, Lind, S. E., Cancer Res. 2000, 60:1887).

This information indicates that 193P1E1B plays a role in the transformation of mammalian cells, supports cell survival and proliferation, and regulates gene transcription by regulating events in the nucleus. Accordingly, when 193P1E1B functions as a regulator of cell transformation, tumor formation, or as a modulator of transcription involved in activating genes associated with inflammation, tumorigenesis or proliferation, 193P1E1B is used for therapeutic, diagnostic, prognostic and/or preventative purposes.

Example 43

Identification and Confirmation of Signal Transduction Pathways

Many mammalian proteins have been reported to interact with signaling molecules and to participate in regulating signaling pathways. (see, e.g., J. Neurochem. 2001; 76:217-223). In particular, adenosine deaminase has been found to associate with G-proteins, thereby regulating several signaling pathways (Ciruela F et al, FEBS Lett. 1996, 380:219). Using immunoprecipitation and Western blotting techniques, proteins are identified that associate with 193P1E1B and mediate signaling events. Several pathways known to play a role in cancer biology can be regulated by 193P1E1B, including phospholipid pathways such as PI3K, AKT, etc, adhesion and migration pathways, including FAK, Rho, Rac-1, etc, as well as mitogenic/survival cascades such as ERK, p38, etc. (Cell Growth Differ. 2000,11:279; J. Biol. Chem. 1999, 274: 801; Oncogene. 2000, 19:3003, J. Cell Biol. 1997, 138:913).

To confirm that 193P1E1B directly or indirectly activates known signal transduction pathways in cells, luciferase (luc) based transcriptional reporter assays are carried out in cells expressing individual genes. These transcriptional reporters contain consensus-binding sites for known transcription factors that lie downstream of well-characterized signal transduction pathways. The reporters and examples of these associated transcription factors, signal transduction pathways, and activation stimuli are listed below.

1. NFkB-luc, NFkB/Rel; Ik-kinase/SAPK; growth/apoptosis/stress
2. SRE-luc, SRF/TCF/ELK1; MAPK/SAPK; growth/differentiation
3. AP-1-luc, FOS/JUN; MAPK/SAPK/PKC; growth/apoptosis/stress
4. ARE-luc, androgen receptor; steroids/MAPK; growth/differentiation/apoptosis
5. p53-luc, p53; SAPK; growth/differentiation/apoptosis
6. CRE-luc, CREB/ATF2; PKA/p38; growth/apoptosis/stress Gene-mediated effects can be assayed in cells showing mRNA expression. Luciferase reporter plasmids can be introduced by lipid-mediated transfection (TFX-50, Promega). Luciferase activity, an indicator of relative transcriptional activity, is measured by incubation of cell extracts with luciferin substrate and luminescence of the reaction is monitored in a luminometer.

Signaling pathways activated by 193P1E1B are mapped and used for the identification and validation of therapeutic targets. When 193P1E1B is involved in cell signaling, it is used as target for diagnostic, prognostic, preventative and/or therapeutic purposes.

Example 44

Involvement in Tumor Progression

The 193P1E1B gene contributes to the growth of cancer cells. The role of 193P1E1B in tumor growth is confirmed in a variety of primary and transfected cell lines including prostate, colon, bladder and kidney cell lines, as well as NIH 3T3 cells engineered to stably express 193P1E1B. Parental cells lacking 193P1E1B and cells expressing 193P1E1B are evaluated for cell growth using a well-documented proliferation assay (Fraser, S. P., et al., Prostate 2000; 44:61, Johnson, D. E., et al., Anticancer Drugs 1996, 7:288).

To confirm the role of 193P1E1B in the transformation process, its effect in colony forming assays is investigated. Parental N1H-3T3 cells lacking 193P1E1B are compared to N1H-3T3 cells expressing 193P1E1B, using a soft agar assay under stringent and more permissive conditions (Song, Z., et al., Cancer Res. 2000; 60:6730).

To confirm the role of 193P1E1B in invasion and metastasis of cancer cells, a well-established assay is used, e.g., a Transwell Insert System assay (Becton Dickinson) (Cancer Res. 1999; 59:6010). Control cells, including prostate, colon, bladder and kidney cell lines lacking 193P1E1B are compared to corresponding cells expressing 193P1E1B. Cells are loaded with the fluorescent dye, calcein, and plated in the top well of the Transwell insert coated with a basement membrane analog. Invasion is determined by fluorescence of cells in the lower chamber relative to the fluorescence of the entire cell population.

193P1E1B can also play a role in cell cycle and apoptosis. Parental cells and cells expressing 193P1E1B are compared for differences in cell cycle regulation using a well-established BrdU assay (Abdel-Malek Z A., J Cell Physiol. 1988, 136:247). In short, cells are grown under both optimal (full serum) and limiting (low serum) conditions, labeled with BrdU and stained with anti-BrdU Ab and propidium iodide. Cells are analyzed for entry into the G1, S, and G2M phases of the cell cycle. Alternatively, the effect of stress on apoptosis is evaluated in control parental cells and cells expressing 193P1E1B, including normal and tumor prostate, colon and lung cells. Engineered and parental cells are treated with various chemotherapeutic agents, such as etoposide, flutamide, etc., and protein synthesis inhibitors, such as cycloheximide. Cells are stained with annexin V-FITC and cell death is measured by FACS analysis. Modulation of cell death by 193P1E1B plays a critical role in regulating tumor progression and tumor load.

When 193P1E1B plays a role in cell growth, transformation, invasion or apoptosis, it is used as a target for diagnostic, prognostic, preventative and/or therapeutic purposes.

Example 45

Involvement in Angiogenesis

Angiogenesis or new capillary blood vessel formation is necessary for tumor growth (Hanahan, D., Folkman, J., Cell 1996, 86:353; Folkan, J., Endocrinology 1998, 139:441). Several assays have been developed to measure angiogenesis in vitro and in vivo, such as the tissue culture assays endothelial cell tube formation and endothelial cell proliferation. Using these assays as well as in vitro neo-vascularization, the role of 193P1E1B in angiogenesis, enhancement or inhibition, is confirmed.

For example, endothelial cells engineered to express 193P1E1B are evaluated using tube formation and proliferation assays. The effect of 193P1E1B is also confirmed in animal models in vivo. For example, cells either expressing or lacking 193P1E1B are implanted subcutaneously in immunocompromised mice. Endothelial cell migration and angiogenesis are evaluated 5-15 days later using immunohistochemistry techniques. 193P1E1B affects angiogenesis, and it is used as a target for diagnostic, prognostic, preventative and/or therapeutic purposes Example 46

Regulation of Transcription

The cellular localization of 193P1E1B (Table XXI) and its similarity to DRADA indicate that 193P1E1B is effectively used as a modulator of the transcriptional regulation of eukaryotic genes. Regulation of gene expression is confirmed, e.g., by studying gene expression in cells expressing or lacking 193P1E1B. For this purpose, two types of experiments are performed.

In the first set of experiments, RNA from parental and 193P1E1B-expressing cells are extracted and hybridized to commercially available gene arrays (Clontech) (Smid-Koopman, E., et al., Br. J. Cancer, 2000, 83:246). Resting cells as well as cells treated with FBS or androgen are compared. Differentially expressed genes are identified in accordance with procedures known in the art. The differentially expressed genes are then mapped to biological pathways (Chen, K., et al. Thyroid 2001, 11:41.).

In the second set of experiments, specific transcriptional pathway activation is evaluated using commercially available (Stratagene) luciferase reporter constructs including: NFkB-luc, SRE-luc, ELK1-luc, ARE-luc, p53-luc, and CRE-luc. These transcriptional reporters contain consensus binding sites for known transcription factors that lie downstream of well-characterized signal transduction pathways, and represent a good tool to ascertain pathway activation and screen for positive and negative modulators of pathway activation.

Accordingly, it s found that 193P1E1B plays a role in gene regulation, and it is used as a target for diagnostic, prognostic, preventative and/or therapeutic purposes.

Example 47

Involvement in Cell Adhesion

Cell adhesion plays a critical role in tissue colonization and metastasis. 193P1E1B participates in cellular organization, and as a consequence cell adhesion and motility. To confirm the role of 193P1E1B in the regulation of cell adhesion, control cells lacking 193P1E1B are compared to cells expressing 193P1E1B, using techniques previously described (see, e.g., Haier et al., Br. J. Cancer, 1999, 80:1867; Lehr and Pienta, J. Natl. Cancer Inst. 1998, 90:118). Briefly, in one embodiment, cells labeled with a fluorescent indicator, such as calcein, are incubated in tissue culture wells coated with media alone or with matrix proteins. Adherent cells are detected by fluorimetric analysis and percent adhesion is calculated. In another embodiment, cells lacking or expressing 193P1E1B are analyzed for their ability to mediate cell-cell adhesion using similar experimental techniques as described above. Both of these experimental systems are used to identify proteins, antibodies and/or small molecules that modulate cell adhesion to extracellular matrix and cell-cell interaction. Cell adhesion plays a critical role in tumor growth, progression, and, colonization, and 193P1E1B is involved in these processes. Thus, 193P1E1B serves as a diagnostic, prognostic, preventative and/or therapeutic modality.

Example 48

Protein-Protein Association

Several adenosine deaminases have been shown to interact with other proteins, thereby regulating gene transcription, gene sequence, as well as cell growth (Raitskin et al., supra). Using immunoprecipitation techniques as well as two yeast hybrid systems, proteins are identified that associate with 193P1E1B. Immunoprecipitates from cells expressing 193P1E1B and cells lacking 193P1E1B are compared for specific protein-protein associations.

Studies are performed to confirm the extent of association of 193P1E1B with effector molecules, such as nuclear proteins, transcription factors, kinases, phsophates, etc. Studies comparing 193P1E1B positive and 193P1E1B negative cells as well as studies comparing unstimulated/resting cells and cells treated with epithelial cell activators, such as cytokines, growth factors, androgen and anti-integrin Ab reveal unique interactions.

In addition, protein-protein interactions are confirmed using two yeast hybrid methodology (Curr. Opin. Chem. Biol. 1999, 3:64). A vector carrying a library of proteins fused to the activation domain of a transcription factor is introduced into yeast expressing a 193P1E1B-DNA-binding domain fusion protein and a reporter construct. Protein-protein interaction is detected by colorimetric reporter activity. Specific association with effector molecules and transcription factors directs one of skill to the mode of action of 193P1E1B, and thus identifies therapeutic, prognostic, preventative and/or diagnostic targets for cancer. This and similar assays are also used to identify and screen for small molecules that interact with 193P1E1B.

Thus it is found that 193P1E1B associates with proteins and small molecules. Accordingly, 193P1E1Band these proteins and small molecules are used for diagnostic, prognostic, preventative and/or therapeutic purposes.

Example 49

Splice Variants of 193P1E1B

Splice variants are also called alternative transcripts. When a gene is transcribed from genomic DNA, the initial RNA is generally spliced to produce functional mRNA, which has only exons and is used for translation into an amino acid sequence. Accordingly, a given gene can have zero to many alternatively spliced mRNA products. Alternative transcripts each have a unique exon makeup, and can have different coding and/or non-coding (5' or 3' end) portions, from the original transcript. Alternative transcripts can code for similar proteins with the same or a similar function or may encode proteins with different functions, and may be expressed in the same tissue at the same time, or at different tissue at different times, proteins encoded by alternative transcripts can have similar or different cellular or extracellular localizations, i.e., be secreted.

Splice variants are identified by a variety of art-accepted methods. For example, splice variants are identified by use of EST data. First, all human ESTs were grouped into clusters which show direct or indirect identity with each other. Second, ESTs in the same cluster were further grouped into sub-clusters and assembled into a consensus sequence. The starting gene is compared to the consensus sequence(s). Each consensus sequence is a potential splice variant for that gene. Even when a variant is identified that is not a full-length clone, that portion of the variant is very useful for antigen generation and for further cloning of the full-length splice variant, using techniques known in the art.

Moreover, computer programs are available in the art that identify splice variants based on genomic sequences. Genomic-based variant identification programs include FgenesH (A. Salamov and V. Solovyev, "Ab initio gene finding in *Drosophila* genomic DNA," Genome Research. 2000 April; 10(4):516-22); Grail and GenScan. For a general discussion of splice variant identification protocols see., e.g., Southan, C., A genomic perspective on human proteases, FEBS Lett. 2001 Jun. 8; 498(2-3):214-8; de Souza, S. J., et al., Identification of human chromosome 22 transcribed sequences with ORF expressed sequence tags, Proc. Natl Acad Sci USA. 2000 Nov. 7; 97(23):12690-3.

For variants identified by the EST-based method, Table XXII shows the nucleotide sequences of the splice variants. Table XXIII shows the alignment of the splice variant with the 193P1E1B v.1 nucleic acid sequence. Table XXIV displays alignments of an amino acid sequence encoded by a splice variant with 193P1E1B v.1. Table XXV lays out amino acid translation of the splice variant for the identified reading frame orientation.

For variants identified by any one of the genomic sequence-based methods, Table XXII shows the nucleotide sequence of the splice variant. Table XXIII shows the alignment of the splice variant with the 193P1E1B v.1 nucleic acid sequence. Table XXIV displays the alignment of amino acid sequence of the predicted transcripts with 193P1E1B v.1. The genomic-based computer programs predict a transcript from genomic sequence, and not only predict exons but also set open reading frame as the first forward open reading frame. The predicted transcript does not contain 5' or 3' untranslated region (UTR). It starts with ATG and ends with a stop codon, TAG, TGA or TAA. In case the transcript is predicted on the reverse strand of the genomic sequence, the sequence of the transcript is reverse-complemented to the genomic sequence of the exons. Thus, the genomic-based programs provide the correct transcript sequence, with 5' to 3' orientation and +1 as the open reading frame. However, due to the possibility of inaccurate prediction of exons or the possibility of sequencing errors in genomic data, other peptides in other forward open reading frame can also be encoded by the variant. Table XXV lays out all amino acid translations of the splice variant(s).

Tables XXII through XXV are set forth herein on a variant-by-variant basis.

To further confirm the parameters of a splice variant, a variety of techniques are available in the art, such as full-length cloning, proteomic validation, PCR-based validation, and 5' RACE validation, etc. (see e.g., Proteomic Validation: Brennan, S. O., et al., Albumin banks peninsula: a new termination variant characterized by electrospray mass spectrometry, Biochem Biophys Acta. 1999 Aug. 17; 1433(1-2): 321-6; Ferranti P, et al., Differential splicing of pre-messenger RNA produces multiple forms of mature caprine alpha(s1)-casein, Eur J. Biochem. 1997 Oct. 1; 249(1):1-7. For PCR-based Validation: Wellmann S, et al., Specific reverse transcription-PCR quantification of vascular endothelial growth factor (VEGF) splice variants by LightCycler technology, Clin Chem. 2001 April; 47(4):654-60; Jia, H. P., et al., Discovery of new human beta-defensins using a genomics-based approach, Gene. 2001 Jan. 24; 263(1-2): 211-8. For PCR-based and 5' RACE Validation: Brigle, K. E., et al., Organization of the murine reduced folate carrier gene and identification of variant splice forms, Biochem Biophys Acta. 1997 Aug. 7; 1353(2): 191-8).

It is known in the art that genomic regions are modulated in cancers. When the genomic region to which 193P1E1B maps is modulated in a particular cancer, the splice variants of 193P1E1B are modulated as well. Disclosed herein is that 193P1E1B has a particular expression profile. Splice variants of 193P1E1B that are structurally and/or functionally similar to 193P1E1B share this expression pattern, thus serving as tumor-associated markers/antigens.

Using the EST assembly approach, four splice variants were identified, one of which has the same open reading frame as 193P1E1B v.3 that we cloned and sequenced. The additional variants are designated as 193P1E1B v.4, 193P1E1B v.5 and 193P1E1B v.6

Throughout this application, various website data content, publications, patent applications and patents are referenced. (Websites are referenced by their Uniform Resource Locator, or URL, addresses on the World Wide Web.) The disclosures of each of these references are hereby incorporated by reference herein in their entireties.

The present invention is not to be limited in scope by the embodiments disclosed herein, which are intended as single illustrations of individual aspects of the invention, and any that are functionally equivalent are within the scope of the invention. Various modifications to the models and methods of the invention, in addition to those described herein, Will become apparent to those skilled in the art from the foregoing description and teachings, and are similarly intended to fall within the scope of the invention. Such modifications or other embodiments can be practiced without departing from the true scope and spirit of the invention.

ITABLES

TABLE I

Tissues that Express 193P1E1B When Malignant

| | |
|---|---|
| Bladder | Ovary |
| Breast | Pancreas |
| Colon | Prostate |
| Kidney | Testis |
| Lung | |

TABLE II

AMINO ACID ABBREVIATIONS

| SINGLE LETTER | THREE LETTER | FULL NAME |
|---|---|---|
| F | Phe | phenylalanine |
| L | Leu | leucine |
| S | Ser | serine |
| Y | Tyr | tyrosine |
| C | Cys | cysteine |
| W | Trp | tryptophan |
| P | Pro | proline |
| H | His | histidine |
| Q | Gln | glutamine |
| R | Arg | arginine |
| I | Ile | isoleucine |
| M | Met | methionine |
| T | Thr | threonine |
| N | Asn | asparagine |
| K | Lys | lysine |
| V | Val | valine |
| A | Ala | alanine |
| D | Asp | aspartic acid |
| E | Glu | glutamic acid |
| G | Gly | glycine |

TABLE III

AMINO ACID SUBSTITUTION MATRIX
Adapted from the GCG Software 9.0 BLOSUM62 amino acid substitution matrix (block substitution matrix). The higher the value, the more likely a substitution is found in related, natural proteins.
(See URL www.ikp.unibe.ch/manual/blosum62.html)

| A | C | D | E | F | G | H | I | K | L | M | N | P | Q | R | S | T | V | W | Y | . |
|---|---|---|---|---|---|---|---|---|---|---|---|---|---|---|---|---|---|---|---|---|
| 4 | 0 | −2 | −1 | −2 | 0 | −2 | −1 | −1 | −1 | −1 | −2 | −1 | −1 | −1 | 1 | 0 | 0 | −3 | −2 | A |
|   | 9 | −3 | −4 | −2 | −3 | −3 | −1 | −3 | −1 | −1 | −3 | −3 | −3 | −3 | −1 | −1 | −1 | −2 | −2 | C |
|   |   | 6 | 2 | −3 | −1 | −1 | −3 | −1 | −4 | −3 | 1 | −1 | 0 | −2 | 0 | −1 | −3 | −4 | −3 | D |
|   |   |   | 5 | −3 | −2 | 0 | −3 | 1 | −3 | −2 | 0 | −1 | 2 | 0 | 0 | −1 | −2 | −3 | −2 | E |
|   |   |   |   | 6 | −3 | −1 | 0 | −3 | 0 | 0 | −3 | −4 | −3 | −3 | −2 | −2 | −1 | 1 | 3 | F |
|   |   |   |   |   | 6 | −2 | −4 | −2 | −4 | −3 | 0 | −2 | −2 | −2 | 0 | −2 | −3 | −2 | −3 | G |
|   |   |   |   |   |   | 8 | −3 | −1 | −3 | −2 | 1 | −2 | 0 | 0 | −1 | −2 | −3 | −2 | 2 | H |
|   |   |   |   |   |   |   | 4 | −3 | 2 | 1 | −3 | −3 | −3 | −3 | −2 | −1 | 3 | −3 | −1 | I |
|   |   |   |   |   |   |   |   | 5 | −2 | −1 | 0 | −1 | 1 | 2 | 0 | −1 | −2 | −3 | −2 | K |
|   |   |   |   |   |   |   |   |   | 4 | 2 | −3 | −3 | −2 | −2 | −2 | −1 | 1 | −2 | −1 | L |
|   |   |   |   |   |   |   |   |   |   | 5 | −2 | −2 | 0 | −1 | −1 | −1 | 1 | −1 | −1 | M |
|   |   |   |   |   |   |   |   |   |   |   | 6 | −2 | 0 | 0 | 1 | 0 | −3 | −4 | −2 | N |
|   |   |   |   |   |   |   |   |   |   |   |   | 7 | −1 | −2 | −1 | −1 | −2 | −4 | −3 | P |
|   |   |   |   |   |   |   |   |   |   |   |   |   | 5 | 1 | 0 | −1 | −2 | −2 | −1 | Q |
|   |   |   |   |   |   |   |   |   |   |   |   |   |   | 5 | −1 | −1 | −3 | −3 | −2 | R |
|   |   |   |   |   |   |   |   |   |   |   |   |   |   |   | 4 | 1 | −2 | −3 | −2 | S |
|   |   |   |   |   |   |   |   |   |   |   |   |   |   |   |   | 5 | 0 | −2 | −2 | T |
|   |   |   |   |   |   |   |   |   |   |   |   |   |   |   |   |   | 4 | −3 | −1 | V |
|   |   |   |   |   |   |   |   |   |   |   |   |   |   |   |   |   |   | 11 | 2 | W |
|   |   |   |   |   |   |   |   |   |   |   |   |   |   |   |   |   |   |   | 7 | Y |

TABLE IV (A)

| | POSITION 2 (Primary Anchor) | POSITION 3 (Primary Anchor) | POSITION C Terminus (Primary Anchor) |
|---|---|---|---|
| SUPERMOTIFS | | | |
| A1 | T*ILVMS* | | FWY |
| A2 | LIVM*ATQ* | | IVM*ATL* |
| A3 | VSM*ATLI* | | RK |
| A24 | YF*WIVLMT* | | FI*YWLM* |
| B7 | P | | VILF*MWYA* |
| B27 | RHK | | FYL*WMIVA* |
| B44 | E*D* | | FWYLIMVA |
| B58 | ATS | | FWY*LIVMA* |
| B62 | QL*IVMP* | | FWY*MIVLA* |
| MOTIFS | | | |
| A1 | TSM | | Y |
| A1 | | DE*AS* | Y |
| A2.1 | LM*VQIAT* | | V*LIMAT* |
| A3 | LMVIS*ATFCGD* | | KYR*HFA* |
| A11 | VTMLISAGN*CDF* | | K*RYH* |
| A24 | YF*WM* | | FLIW |
| A*3101 | MVT*ALIS* | | R*K* |
| A*3301 | MVALF*IST* | | RK |
| A*6801 | AVT*MSLI* | | RK |
| B*0702 | P | | LMF*WYAIV* |
| B*3501 | P | | LMFWY*IVA* |
| B51 | P | | LIVF*WYAM* |
| B*5301 | P | | IMFWY*ALV* |
| B*5401 | P | | ATIVLMFWY |

Bolded residues are preferred, italicized residues are less preferred:

A peptide is considered motif-bearing if it has primary anchors at each primary anchor position for a motif or supermotif as specified in the above table.

TABLE IV (B)

HLA CLASS II SUPERMOTIF

| 1 | 6 | 9 |
|---|---|---|
| W, F, Y, V, .I, L | A, V, I, L, P, C, S, T | A, V, I, L, C, S, T, M, Y |

TABLE IV (C)

| MOTIFS | | 1° anchor 1 | 2 | 3 | 4 | 5 | 1° anchor 6 | 7 | 8 | 9 |
|---|---|---|---|---|---|---|---|---|---|---|
| DR4 | preferred | FMY*LIVW* | M | T | | I | VST*CPALIM* | MH | | MH |
| | deleterious | | | | W | | | R | | WDE |
| DR1 | preferred | MF*LIVWY* | | | PAMQ | | VMAT*SPLIC* | M | | AVM |
| | deleterious | | C | CH | FD | CWD | | GDE | D | |
| DR7 | preferred | MF*LIVWY* | M | W | A | | IVMSA*CTPL* | M | | IV |
| | deleterious | | C | | G | | | GRD | N | G |
| DR3 motif a preferred | MOTIFS | 1° anchor 1<br>LIVMFY | 2 | 3 | 1° anchor 4<br>D | 5 | 1° anchor 6 | | | |
| motif b preferred | | LIVMFAY | | | DNQEST | | KRH | | | |
| DR Supermotif | | MF*LIVWY* | | | | | VMSTA*CPLI* | | | |

Italicized residues indicate less preferred or "tolerated" residues.

TABLE IV (D)

| SUPERMOTIFS | | POSITION | | | | | | | | |
|---|---|---|---|---|---|---|---|---|---|---|
| | | 1 | 2 | 3 | 4 | 5 | 6 | 7 | 8 | C-terminus |
| A1 | | | 1° Anchor<br>TI*LVMS* | | | | | | | 1° Anchor<br>FWY |
| A2 | | | 1° Anchor<br>LIVM*ATQ* | | | | | | | 1° Anchor<br>LIVMAT |
| A3 | preferred | | 1° Anchor<br>VSMA*TLI* | YFW (4/5) | | | YFW (3/5) | YFW (4/5) | P (4/5) | 1° Anchor<br>RK |
| | deleterious | DE (3/5);<br>P (5/5) | | DE (4/5) | | | | | | |
| A24 | | | 1° Anchor<br>YF*WIVLMT* | | | | | | | 1° Anchor<br>FIY*WLM* |
| B7 | preferred | FWY (5/5)<br>LIVM (3/5) | 1° Anchor<br>P | FWY (4/5) | | | | | FWY (3/5) | 1° Anchor<br>VILF*MWYA* |
| | deleterious | DE (3/5);<br>P (5/5);<br>G (4/5);<br>A (3/5);<br>QN (3/5) | | | | | DE (3/5) | G (4/5) | QN (4/5) | DE (3/5) |
| B27 | | | 1° Anchor<br>RHK | | | | | | | 1° Anchor<br>FYL*WMIVA* |
| B44 | | | 1° Anchor<br>E*D* | | | | | | | 1° Anchor<br>FWYLIMVA |
| B58 | | | 1° Anchor<br>ATS | | | | | | | 1° Anchor<br>FWY*LIVMA* |
| B62 | | | 1° Anchor<br>QL*IVMP* | | | | | | | 1° Anchor<br>FWY*MIVLA* |

TABLE IV (E)

| | | 1 | 2 | 3 | 4 | 5 |
|---|---|---|---|---|---|---|
| A1 9-mer | preferred | GFYW | 1° Anchor<br>STM | DEA | YFW | |
| | deleterious | DE | | RHKLIVMP | A | G |
| A1 9-mer | preferred | GRHK | ASTCLIVM | 1° Anchor<br>DEAS | GSTC | |
| | deleterious | A | RHKDEPYFW | | DE | PQN |
| A1 10-mer | preferred | YFW | 1° Anchor<br>STM | DEAQN | A | YFWQN |
| | deleterious | GP | | RHKGLIVM | DE | RHK |

TABLE IV (E)-continued

| | | 1 | 2 | 3 | 4 | 5 |
|---|---|---|---|---|---|---|
| A1 10-mer | preferred | YFW | STCLIVM | 1° Anchor DE*AS* | A | YFW |
| | deleterious | RHK | RHKDEPYFW | | | P |
| A2.1 9-mer | preferred | YFW | 1° Anchor LM*IVQAT* | YFW | STC | YFW |
| | deleterious | DEP | | DERKH | | |
| A2.1 10-mer | preferred | AYFW | 1° Anchor LM*IVQAT* | LVIM | G | |
| | deleterious | DEP | | DE | RKHA | P |
| A3 | preferred | RHK | 1° Anchor LMVISATFCGD | YFW | PRHKYFW | A |
| | deleterious | DEP | | DE | | |
| A11 | preferred | A | 1° Anchor VTLMISAGN*CDF* | YFW | YFW | A |
| | deleterious | DEP | | | | |
| A24 9-mer | preferred | YFWRHK | 1° Anchor YFW*M* | | STC | |
| | deleterious | DEG | | DE | G | QNP |
| A24 10-mer | preferred | | 1° Anchor YFW*M* | | P | YFWP |
| | deleterious | | | GDE | QN | RHK |
| A3101 | preferred | RHK | 1° Anchor MVT*ALIS* | YFW | P | |
| | deleterious | DEP | | DE | | ADE |
| A3301 | preferred | | 1° Anchor MVALF*IST* | YFW | | |
| | deleterious | GP | | DE | | |
| A6801 | preferred | YFWSTC | 1° Anchor AVT*MSLI* | | | YFWLIVM |
| | deleterious | GP | | DEG | | RHK |
| B0702 | preferred | RHKFWY | 1° Anchor P | RHK | | RHK |
| | deleterious | DEQNP | | DEP | DE | DE |
| B3501 | preferred | FWYLIVM | 1° Anchor P | FWY | | |
| | deleterious | AGP | | | | G |
| B51 | preferred | LIVMFWY | 1° Anchor P | FWY | STC | FWY |
| | deleterious | AGPDERHKSTC | | | | DE |
| B5301 | preferred | LIVMFWY | 1° Anchor P | FWY | STC | FWY |
| | deleterious | AGPQN | | | | |
| B5401 | preferred | FWY | 1° Anchor P | FWYLIVM | | LIVM |
| | deleterious | GPQNDE | | GDESTC | | RHKDE |

| | | 6 | 7 | 8 | 9 or C-terminus | C-terminus |
|---|---|---|---|---|---|---|
| A1 9-mer | preferred | P | DEQN | YFW | 1° Anchor Y | |
| | deleterious | A | | | | |
| A1 9-mer | preferred | ASTC | LIVM | DE | 1° Anchor Y | |
| | deleterious | RHK | PG | GP | | |
| A1 10-mer | preferred | | PASTC | GDE | P | 1° Anchor Y |
| | deleterious | QNA | RHKYFW | RHK | A | |
| A1 10-mer | preferred | | PG | | YFW | 1° Anchor Y |
| | deleterious | G | | PRHK | QN | |
| A2.1 9-mer | preferred | | A | P | 1° Anchor V*LIMAT* | |
| | deleterious | RKH | DERKH | | | |
| A2.1 10-mer | preferred | G | RKH | FYWL VIM | | 1° Anchor V*LIMAT* |
| | deleterious | | RKH | DERKH | RKH | |
| A3 | preferred | YFW | | P | 1° Anchor KYR*HFA* | |
| | deleterious | | | | | |
| A11 | preferred | YFW | YFW | P | 1° Anchor K*RYH* | |
| | deleterious | | A | G | | |
| A24 9-mer | preferred | | YFW | YFW | 1° Anchor FLIW | |
| | deleterious | DERHK | | G | AQN | |

TABLE IV (E)-continued

| | | | | | | |
|---|---|---|---|---|---|---|
| A24 10-mer | preferred | | | P | | 1° Anchor FLIW |
| | deleterious | DE | | A | QN | DEA |
| A3101 | preferred | YFW | | YFW | AP | 1° Anchor R*K* |
| | deleterious | DE | | DE | DE | |
| A3301 | preferred | | | AYFW | | 1° Anchor RK |
| | deleterious | | | | | |
| A6801 | preferred | | | YFW | P | 1° Anchor RK |
| | deleterious | | | | A | |
| B0702 | preferred | RHK | | RHK | PA | 1° Anchor LMF*WYAIV* |
| | deleterious | GDE | | QN | DE | |
| B3501 | preferred | | | FWY | | 1° Anchor LMFWY*IVA* |
| | deleterious | G | | | | |
| B51 | preferred | | | G | FWY | 1° Anchor LIVF*WYAM* |
| | deleterious | G | | DEQN | GDE | |
| B5301 | preferred | | | LIVMFWY | FWY | 1° Anchor IMFWY*ALV* |
| | deleterious | G | | RHKQN | DE | |
| B5401 | preferred | | | ALIVM | FWYAP | 1° Anchor ATIV*LMFWY* |
| | deleterious | DE | | QNDGE | DE | |

Italicized residues indicate less preferred or "tolerated" residues. The information in this Table is specific for 9-mers unless otherwise specified.

TABLE V (A)

HLA PEPTIDE SCORING RESULTS - 193P1E1B - A1, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 19 | DCETARLQR | 45.000 | 1. |
| 2 | 158 | LSDFGLERY | 37.500 | 2. |
| 3 | 341 | LTDPSSPTI | 25.000 | 3. |
| 4 | 72 | GIDFIKATK | 20.000 | 4. |
| 5 | 138 | LSDPPVASS | 15.000 | 5. |
| 6 | 69 | NQEGIDFIK | 13.500 | 6. |
| 7 | 272 | QLEKSDAEY | 9.000 | 7. |
| 8 | 118 | NSDPELSNC | 7.500 | 8. |
| 9 | 28 | ALDGEESDF | 5.000 | 9. |
| 10 | 31 | GEESDFEDY | 2.250 | 10. |
| 11 | 253 | DTESRLNDN | 2.250 | 11. |
| 12 | 123 | LSNCENFQK | 1.500 | 12. |
| 13 | 33 | ESDFEDYPM | 1.500 | 13. |
| 14 | 306 | VSTNYPLSK | 1.500 | 14. |
| 15 | 225 | ISEYTMCLN | 1.350 | 15. |
| 16 | 131 | KTDVKDDLS | 1.250 | 16. |
| 17 | 37 | EDYPMRILY | 1.250 | 17. |
| 18 | 319 | SNDLEVEDR | 1.250 | 18. |
| 19 | 228 | YTMCLNEDY | 1.250 | 19. |
| 20 | 232 | LNEDYTMGL | 1.125 | 20. |
| 21 | 389 | KAVPPSKRF | 1.000 | 21. |
| 22 | 358 | TPTPPEVTK | 1.000 | 22. |
| 23 | 215 | CVTPKLEHF | 1.000 | 23. |
| 24 | 17 | TLDCETARL | 1.000 | 24. |
| 25 | 321 | DLEVEDRTS | 0.900 | 25. |
| 26 | 277 | DAEYTNSPL | 0.900 | 26. |
| 27 | 323 | EVEDRTSLV | 0.900 | 27. |
| 28 | 344 | PSSPTISSY | 0.750 | 28. |
| 29 | 275 | KSDAEYTNS | 0.750 | 29. |
| 30 | 333 | NSDTCFENL | 0.750 | 30. |
| 31 | 349 | ISSYENLLR | 0.750 | 31. |
| 32 | 48 | HSEVQTLKD | 0.675 | 32. |
| 33 | 263 | FATPSPIIQ | 0.500 | 33. |
| 34 | 382 | LATPIAIKA | 0.500 | 34. |
| 35 | 302 | SIALVSTNY | 0.500 | 35. |
| 36 | 251 | AIDTESRLN | 0.500 | 36. |
| 37 | 233 | NEDYTMGLK | 0.500 | 37. |
| 38 | 370 | DILQLLSKY | 0.500 | 38. |
| 39 | 281 | TNSPLVPTF | 0.500 | 39. |
| 40 | 157 | QLSDFGLER | 0.500 | 40. |
| 41 | 219 | KLEHFGISE | 0.450 | 41. |
| 42 | 381 | NLATPIAIK | 0.400 | 42. |
| 43 | 16 | STLDCETAR | 0.250 | 43. |
| 44 | 267 | SPIIQQLEK | 0.250 | 44. |
| 45 | 61 | LLDKARLEN | 0.250 | 45. |
| 46 | 236 | YTMGLKNAR | 0.250 | 46. |
| 47 | 189 | VTPPTKQSL | 0.250 | 47. |
| 48 | 209 | KMDDFECVT | 0.250 | 48. |
| 49 | 391 | VPPSKRFLK | 0.250 | 49. |
| 50 | 82 | LMEKNSMDI | 0.225 | 50. |

TABLE VI (A)

HLA PEPTIDE SCORING RESULTS - 193P1E1B - A1, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 66 | RLENQEGIDF | 45.000 | 51. |
| 2 | 219 | KLEHFGISEY | 45.000 | 52. |
| 3 | 33 | ESDFEDYPMR | 15.000 | 53. |
| 4 | 341 | LTDPSSPTIS | 12.500 | 54. |
| 5 | 87 | SMDIMKIREY | 12.500 | 55. |
| 6 | 30 | DGEESDFEDY | 11.250 | 56. |
| 7 | 390 | AVPPSKRFLK | 10.000 | 57. |
| 8 | 138 | LSDPPVASSC | 7.500 | 58. |
| 9 | 36 | FEDYPMRILY | 6.250 | 59. |
| 10 | 93 | IREYFQKYGY | 4.500 | 60. |
| 11 | 232 | LNEDYTMGLK | 4.500 | 61. |
| 12 | 323 | EVEDRTSLVL | 4.500 | 62. |
| 13 | 55 | KDDVNILLDK | 2.500 | 63. |
| 14 | 253 | DTESRLNDNV | 2.250 | 64. |
| 15 | 120 | DPELSNCENF | 2.250 | 65. |
| 16 | 277 | DAEYTNSPLV | 1.800 | 66. |
| 17 | 247 | KSEEAIDTES | 1.350 | 67. |
| 18 | 367 | IPEDILQLLS | 1.125 | 68. |
| 19 | 122 | ELSNCENFQK | 1.000 | 69. |
| 20 | 357 | RTPTPPEVTK | 1.000 | 70. |
| 21 | 305 | LVSTNYPLSK | 1.000 | 71. |
| 22 | 125 | NCENFQKTDV | 0.900 | 72. |
| 23 | 321 | DLEVEDRTSL | 0.900 | 73. |
| 24 | 19 | DCETARLQRA | 0.900 | 74. |
| 25 | 118 | NSDPELSNCE | 0.750 | 75. |
| 26 | 158 | LSDFGLERYI | 0.750 | 76. |
| 27 | 333 | NSDTCFENLT | 0.750 | 77. |
| 28 | 301 | NSIALVSTNY | 0.750 | 78. |
| 29 | 225 | ISEYTMCLNE | 0.675 | 79. |
| 30 | 69 | NQEGIDFIKA | 0.675 | 80. |
| 31 | 131 | KTDVKDDLSD | 0.625 | 81. |
| 32 | 263 | FATPSPIIQQ | 0.500 | 82. |
| 33 | 157 | QLSDFGLERY | 0.500 | 83. |
| 34 | 17 | TLDCETARLQ | 0.500 | 84. |
| 35 | 289 | FCTPGLKIPS | 0.500 | 85. |
| 36 | 348 | TISSYENLLR | 0.500 | 86. |
| 37 | 210 | MDDFECVTPK | 0.500 | 87. |
| 38 | 72 | GIDFIKATKV | 0.500 | 88. |
| 39 | 280 | YTNSPLVPTF | 0.500 | 89. |
| 40 | 248 | SEEAIDTESR | 0.450 | 90. |
| 41 | 368 | PEDILQLLSK | 0.250 | 91. |
| 42 | 251 | AIDTESRLND | 0.250 | 92. |
| 43 | 189 | VTPPTKQSLV | 0.250 | 93. |
| 44 | 68 | ENQEGIDFIK | 0.250 | 94. |
| 45 | 190 | TPPTKQSLVK | 0.250 | 95. |
| 46 | 46 | DLHSEVQTLK | 0.200 | 96. |
| 47 | 266 | PSPIIQQLEK | 0.150 | 97. |
| 48 | 145 | SSCISEKSPR | 0.150 | 98. |
| 49 | 271 | QQLEKSDAEY | 0.150 | 99. |
| 50 | 318 | SSNDLEVEDR | 0.150 | 100. |

TABLE VII (A)

HLA PEPTIDE SCORING RESULTS - 193P1E1B - A2, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 43 | ILYDLHSEV | 1551.288 | 101. |
| 2 | 257 | RLNDNVFAT | 407.580 | 102. |
| 3 | 171 | VLPNPPQAV | 118.238 | 103. |
| 4 | 366 | KIPEDILQL | 96.947 | 104. |
| 5 | 209 | KMDDFECVT | 48.131 | 105. |
| 6 | 374 | LLSKYNSNL | 36.316 | 106. |
| 7 | 340 | NLTDPSSPT | 30.553 | 107. |
| 8 | 304 | ALVSTNYPL | 21.362 | 108. |
| 9 | 229 | TMCLNEDYT | 14.504 | 109. |
| 10 | 224 | GISEYTMCL | 12.043 | 110. |
| 11 | 59 | NILLDKARL | 10.868 | 111. |
| 12 | 17 | TLDCETARL | 8.545 | 112. |
| 13 | 10 | KLRSLASTL | 5.682 | 113. |
| 14 | 199 | KVLKTPKCA | 5.629 | 114. |
| 15 | 80 | KVLMEKNSM | 5.629 | 115. |
| 16 | 39 | YPMRILYDL | 5.459 | 116. |
| 17 | 295 | KIPSTKNSI | 5.021 | 117. |
| 18 | 278 | AEYTNSPLV | 4.328 | 118. |
| 19 | 46 | DLHSEVQTL | 3.685 | 119. |
| 20 | 261 | NVFATPSPI | 3.378 | 120. |
| 21 | 348 | TISSYENLL | 2.937 | 121. |
| 22 | 322 | LEVEDRTSL | 2.895 | 122. |
| 23 | 53 | TLKDDVNIL | 2.891 | 123. |
| 24 | 329 | SLVLNSDTC | 2.434 | 124. |
| 25 | 208 | LKMDDFECV | 2.319 | 125. |
| 26 | 383 | ATPIAIKAV | 2.222 | 126. |
| 27 | 390 | AVPPSKRFL | 2.056 | 127. |
| 28 | 170 | QVLPNPPQA | 1.608 | 128. |
| 29 | 350 | SSYENLLRT | 1.468 | 129. |
| 30 | 126 | CENFQKTDV | 1.352 | 130. |
| 31 | 200 | VLKTPKCAL | 1.271 | 131. |
| 32 | 280 | YTNSPLVPT | 1.095 | 132. |
| 33 | 283 | SPLVPTFCT | 1.044 | 133. |
| 34 | 314 | KTNSSSNDL | 1.038 | 134. |
| 35 | 207 | ALKMDDFEC | 1.009 | 135. |
| 36 | 270 | IQQLEKSDA | 0.856 | 136. |
| 37 | 82 | LMEKNSMDI | 0.820 | 137. |
| 38 | 155 | SPQLSDFGL | 0.809 | 138. |
| 39 | 371 | ILQLLSKYN | 0.697 | 139. |
| 40 | 352 | YENLLRTPT | 0.667 | 140. |
| 41 | 254 | TESRLNDNV | 0.663 | 141. |
| 42 | 73 | IDFIKATKV | 0.608 | 142. |
| 43 | 85 | KNSMDIMKI | 0.548 | 143. |
| 44 | 52 | QTLKDDVNI | 0.536 | 144. |
| 45 | 189 | VTPPTKQSL | 0.504 | 145. |
| 46 | 231 | CLNEDYTMG | 0.458 | 146. |
| 47 | 316 | NSSSNDLEV | 0.454 | 147. |
| 48 | 190 | TPPTKQSLV | 0.454 | 148. |
| 49 | 195 | QSLVKVLKT | 0.414 | 149. |
| 50 | 373 | QLLSKYNSN | 0.414 | 150. |

TABLE VIII (A)

HLA PEPTIDE SCORING RESULTS - 193P1E1B - A2, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 81 | VLMEKNSMDI | 269.051 | 151. |
| 2 | 366 | KIPEDILQLL | 96.947 | 152. |
| 3 | 231 | CLNEDYTMGL | 87.586 | 153. |
| 4 | 373 | QLLSKYNSNL | 79.041 | 154. |
| 5 | 340 | NLTDPSSPTI | 42.774 | 155. |
| 6 | 42 | RILYDLHSEV | 35.385 | 156. |
| 7 | 199 | KVLKTPKCAL | 24.206 | 157. |
| 8 | 170 | QVLPNPPQAV | 22.517 | 158. |
| 9 | 162 | GLERYIVSQV | 10.238 | 159. |
| 10 | 322 | LEVEDRTSLV | 9.426 | 160. |
| 11 | 355 | LLRTPTPPEV | 8.986 | 161. |
| 12 | 374 | LLSKYNSNLA | 8.446 | 162. |
| 13 | 13 | SLASTLDCET | 7.452 | 163. |
| 14 | 194 | KQSLVKVLKT | 6.082 | 164. |
| 15 | 381 | NLATPIAIKA | 4.968 | 165. |
| 16 | 228 | YTMCLNEDYT | 4.747 | 166. |
| 17 | 16 | STLDCETARL | 4.501 | 167. |
| 18 | 72 | GIDFIKATKV | 3.825 | 168. |
| 19 | 382 | LATPIAIKAV | 3.777 | 169. |
| 20 | 229 | TMCLNEDYTM | 3.588 | 170. |
| 21 | 285 | LVPTFCTPGL | 3.178 | 171. |
| 22 | 188 | IVTPPTKQSL | 3.178 | 172. |
| 23 | 53 | TLKDDVNILL | 3.066 | 173. |
| 24 | 178 | AVNNYKEEPV | 2.982 | 174. |
| 25 | 207 | ALKMDDFECV | 2.266 | 175. |
| 26 | 67 | LENQEGIDFI | 2.138 | 176. |
| 27 | 102 | YSPRVKKNSV | 2.088 | 177. |
| 28 | 60 | ILLDKARLEN | 1.922 | 178. |
| 29 | 303 | IALVSTNYPL | 1.866 | 179. |
| 30 | 51 | VQTLKDDVNI | 1.798 | 180. |
| 31 | 189 | VTPPTKQSLV | 1.642 | 181. |
| 32 | 206 | CALKMDDFEC | 1.481 | 182. |
| 33 | 216 | VTPKLEHFGI | 1.429 | 183. |
| 34 | 261 | NVFATPSPII | 1.385 | 184. |
| 35 | 272 | QLEKSDAEYT | 1.285 | 185. |
| 36 | 70 | QEGIDFIKAT | 1.266 | 186. |
| 37 | 45 | YDLHSEVQTL | 1.161 | 187. |
| 38 | 269 | IIQQLEKSDA | 1.161 | 188. |
| 39 | 389 | KAVPPSKRFL | 1.142 | 189. |
| 40 | 97 | FQKYGYSPRV | 1.135 | 190. |
| 41 | 52 | QTLKDDVNIL | 1.035 | 191. |
| 42 | 295 | KIPSTKNSIA | 0.980 | 192. |
| 43 | 332 | LNSDTCFENL | 0.905 | 193. |
| 44 | 154 | RSPQLSDFGL | 0.809 | 194. |
| 45 | 331 | VLNSDTCFEN | 0.735 | 195. |
| 46 | 264 | ATPSPIIQQL | 0.682 | 196. |
| 47 | 220 | LEHFGISEYT | 0.664 | 197. |
| 48 | 49 | SEVQTLKDDV | 0.663 | 198. |
| 49 | 223 | FGISEYTMCL | 0.641 | 199. |
| 50 | 180 | NNYKEEPVIV | 0.596 | 200. |

TABLE IX (A)

HLA PEPTIDE SCORING RESULTS - 193P1E1B - A3, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 239 | GLKNARNNK | 60.000 | 201. |
| 2 | 381 | NLATPIAIK | 45.000 | 202. |
| 3 | 157 | QLSDFGLER | 24.000 | 203. |
| 4 | 92 | KIREYFQKY | 16.200 | 204. |
| 5 | 72 | GIDFIKATK | 9.000 | 205. |
| 6 | 69 | NQEGIDFIK | 4.050 | 206. |
| 7 | 397 | FLKHGQNIR | 4.000 | 207. |
| 8 | 272 | QLEKSDAEY | 4.000 | 208. |
| 9 | 387 | AIKAVPPSK | 3.000 | 209. |
| 10 | 28 | ALDGEESDF | 3.000 | 210. |
| 11 | 304 | ALVSTNYPL | 2.700 | 211. |
| 12 | 194 | KQSLVKVLK | 2.700 | 212. |
| 13 | 77 | KATKVLMEK | 2.700 | 213. |
| 14 | 197 | LVKVLKTPK | 2.000 | 214. |
| 15 | 10 | KLRSLASTL | 1.800 | 215. |
| 16 | 374 | LLSKYNSNL | 1.800 | 216. |
| 17 | 53 | TLKDDVNIL | 1.800 | 217. |
| 18 | 224 | GISEYTMCL | 1.620 | 218. |
| 19 | 82 | LMEKNSMDI | 1.200 | 219. |
| 20 | 43 | ILYDLHSEV | 1.000 | 220. |
| 21 | 257 | RLNDVFAT | 0.900 | 221. |
| 22 | 200 | VLKTPKCAL | 0.900 | 222. |
| 23 | 209 | KMDDFECVT | 0.900 | 223. |
| 24 | 366 | KIPEDILQL | 0.810 | 224. |
| 25 | 302 | SIALVSTNY | 0.600 | 225. |
| 26 | 267 | SPIIQQLEK | 0.600 | 226. |
| 27 | 207 | ALKMDDFEC | 0.600 | 227. |
| 28 | 17 | TLDCETARL | 0.600 | 228. |
| 29 | 306 | VSTNYPLSK | 0.600 | 229. |
| 30 | 391 | VPPSKRFLK | 0.600 | 230. |
| 31 | 46 | DLHSEVQTL | 0.540 | 231. |
| 32 | 215 | CVTPKLEHF | 0.450 | 232. |
| 33 | 236 | YTMGLKNAR | 0.450 | 233. |
| 34 | 358 | TPTPPEVTK | 0.450 | 234. |
| 35 | 219 | KLEHFGISE | 0.360 | 235. |
| 36 | 228 | YTMCLNEDY | 0.300 | 236. |
| 37 | 16 | STLDCETAR | 0.300 | 237. |
| 38 | 186 | PVIVTPPTK | 0.300 | 238. |
| 39 | 329 | SLVLNSDTC | 0.300 | 239. |
| 40 | 261 | NYFATPSPI | 0.300 | 240. |
| 41 | 143 | VASSCISEK | 0.300 | 241. |
| 42 | 171 | VLPNPPQAV | 0.300 | 242. |
| 43 | 123 | LSNCENFQK | 0.300 | 243. |
| 44 | 330 | LVLNSDTCF | 0.300 | 244. |
| 45 | 2 | DPIRSFCGK | 0.270 | 245. |
| 46 | 162 | GLERYIVSQ | 0.270 | 246. |
| 47 | 370 | DILQLLSKY | 0.270 | 247. |
| 48 | 402 | QNIRDVSNK | 0.180 | 248. |
| 49 | 94 | REYFQKYGY | 0.180 | 249. |
| 50 | 295 | KIPSTKNSI | 0.180 | 250. |

TABLE X (A)

HLA PEPTIDE SCORING RESULTS - 193P1E1B - A3, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 90 | IMKIREYFQK | 60.000 | 251. |
| 2 | 196 | SLVKVLKTPK | 30.000 | 252. |
| 3 | 200 | VLKTPKCALK | 20.000 | 253. |
| 4 | 219 | KLEHFGISEY | 18.000 | 254. |
| 5 | 122 | ELSNCENFQK | 18.000 | 255. |
| 6 | 305 | LVSTNYPLSK | 12.000 | 256. |
| 7 | 46 | DLHSEVQTLK | 9.000 | 257. |
| 8 | 390 | AVPPSKRFLK | 9.000 | 258. |
| 9 | 157 | QLSDFGLERY | 6.000 | 259. |
| 10 | 231 | CLNEDYTMGL | 5.400 | 260. |
| 11 | 401 | GQNIRDVSNK | 5.400 | 261. |
| 12 | 66 | RLENQEGIDF | 4.000 | 262. |
| 13 | 329 | SLVLNSDTCF | 3.000 | 263. |
| 14 | 81 | VLMEKNSMDI | 2.700 | 264. |
| 15 | 162 | GLERYIVSQV | 2.700 | 265. |
| 16 | 373 | QLLSKYNSNL | 2.700 | 266. |
| 17 | 53 | TLKDDVNILL | 1.800 | 267. |
| 18 | 357 | RTPTPPEVTK | 1.500 | 268. |
| 19 | 348 | TISSYENLLR | 0.800 | 269. |
| 20 | 366 | KIPEDILQLL | 0.608 | 270. |
| 21 | 207 | ALKMDDFECV | 0.600 | 271. |
| 22 | 340 | NLTDPSSPTI | 0.600 | 272. |
| 23 | 87 | SMDIMKIREY | 0.600 | 273. |
| 24 | 381 | NLATPIAIKA | 0.600 | 274. |
| 25 | 229 | TMCLNEDYTM | 0.600 | 275. |
| 26 | 387 | AIKAVPPSKR | 0.600 | 276. |
| 27 | 386 | IAIKAVPPSK | 0.450 | 277. |
| 28 | 261 | NVFATPSPII | 0.450 | 278. |
| 29 | 199 | KVLKTPKCAL | 0.405 | 279. |
| 30 | 190 | TPPTKQSLVK | 0.400 | 280. |
| 31 | 174 | NPPQAVNNYK | 0.300 | 281. |
| 32 | 280 | YTNSPLVPTF | 0.300 | 282. |
| 33 | 82 | LMEKNSMDIM | 0.300 | 283. |
| 34 | 142 | PVASSCISEK | 0.300 | 284. |
| 35 | 291 | TPGLKIPSTK | 0.300 | 285. |
| 36 | 55 | KDDVNILLDK | 0.270 | 286. |
| 37 | 271 | QQLEKSDAEY | 0.270 | 287. |
| 38 | 355 | LLRTPTPPEV | 0.200 | 288. |
| 39 | 374 | LLSKYNSNLA | 0.200 | 289. |
| 40 | 321 | DLEVEDRTSL | 0.180 | 290. |
| 41 | 52 | QTLKDDVNIL | 0.135 | 291. |
| 42 | 380 | SNLATPIAIK | 0.135 | 292. |
| 43 | 83 | MEKNSMDIMK | 0.120 | 293. |
| 44 | 239 | GLKNARNNKS | 0.120 | 294. |
| 45 | 371 | ILQLLSKYNS | 0.120 | 295. |
| 46 | 156 | PQLSDFGLER | 0.108 | 296. |
| 47 | 43 | ILYDLHSEVQ | 0.100 | 297. |
| 48 | 13 | SLASTLDCET | 0.100 | 298. |
| 49 | 272 | QLEKSDAEYT | 0.100 | 299. |
| 50 | 76 | IKATKVLMEK | 0.090 | 300. |

TABLE XI (A)

HLA PEPTIDE SCORING RESULTS - 193P1E1B - A11, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 197 | LVKVLKTPK | 2.000 | 301. |
| 2 | 69 | NQEGIDFIK | 1.800 | 302. |
| 3 | 194 | KQSLVKVLK | 1.800 | 303. |
| 4 | 77 | KATKVLMEK | 1.200 | 304. |
| 5 | 72 | GIDFIKATK | 1.200 | 305. |
| 6 | 239 | GLKNARNNK | 1.200 | 306. |
| 7 | 267 | SPIIQQLEK | 0.600 | 307. |
| 8 | 391 | VPPSKRFLK | 0.600 | 308. |
| 9 | 387 | AIKAVPPSK | 0.400 | 309. |
| 10 | 381 | NLATPIAIK | 0.400 | 310. |
| 11 | 236 | YTMGLKNAR | 0.400 | 311. |
| 12 | 16 | STLDCETAR | 0.300 | 312. |
| 13 | 186 | PVIVTPPTK | 0.300 | 313. |
| 14 | 143 | VASSCISEK | 0.200 | 314. |
| 15 | 358 | TPTPPEVTK | 0.200 | 315. |
| 16 | 287 | PTFCTPGLK | 0.200 | 316. |
| 17 | 157 | QLSDFGLER | 0.160 | 317. |
| 18 | 99 | KYGYSPRVK | 0.120 | 318. |
| 19 | 97 | FQKYGYSPR | 0.120 | 319. |
| 20 | 91 | MKIREYFQK | 0.090 | 320. |
| 21 | 80 | KVLMEKNSM | 0.090 | 321. |
| 22 | 2 | DPIRSFCGK | 0.090 | 322. |
| 23 | 397 | FLKHGQNIR | 0.080 | 323. |
| 24 | 402 | QNIRDVSNK | 0.060 | 324. |
| 25 | 123 | LSNCENFQK | 0.060 | 325. |
| 26 | 202 | KTPKCALKM | 0.060 | 326. |
| 27 | 233 | NEDYTMGLK | 0.060 | 327. |
| 28 | 146 | SCISEKSPR | 0.060 | 328. |
| 29 | 199 | KVLKTPKCA | 0.045 | 329. |
| 30 | 191 | PPTKQSLVK | 0.040 | 330. |
| 31 | 100 | YGYSPRVKK | 0.040 | 331. |
| 32 | 261 | NVFATPSPI | 0.040 | 332. |
| 33 | 306 | VSTNYPLSK | 0.040 | 333. |
| 34 | 330 | LVLNSDTCF | 0.030 | 334. |
| 35 | 314 | KTNSSSNDL | 0.030 | 335. |
| 36 | 170 | QVLPNPPQA | 0.030 | 336. |
| 37 | 224 | GISEYTMCL | 0.024 | 337. |
| 38 | 19 | DCETARLQR | 0.024 | 338. |
| 39 | 366 | KIPEDILQL | 0.024 | 339. |
| 40 | 127 | ENFQKTDVK | 0.024 | 340. |
| 41 | 201 | LKTPKCALK | 0.020 | 341. |
| 42 | 215 | CVTPKLEHF | 0.020 | 342. |
| 43 | 175 | PPQAVNNYK | 0.020 | 343. |
| 44 | 228 | YTMCLNEDY | 0.020 | 344. |
| 45 | 47 | LHSEVQTLK | 0.020 | 345. |
| 46 | 369 | EDILQLLSK | 0.018 | 346. |
| 47 | 56 | DDVNILLDK | 0.018 | 347. |
| 48 | 52 | QTLKDDVNI | 0.015 | 348. |
| 49 | 10 | KLRSLASTL | 0.012 | 349. |
| 50 | 211 | DDFECVTPK | 0.012 | 350. |

TABLE XII (A)

HLA PEPTIDE SCORING RESULTS - 193P1E1B - A11, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 390 | AVPPSKRFLK | 6.000 | 351. |
| 2 | 305 | LVSTNYPLSK | 4.000 | 352. |
| 3 | 357 | RTPTPPEVTK | 3.000 | 353. |
| 4 | 401 | GQNIRDVSNK | 1.800 | 354. |
| 5 | 90 | IMKIREYFQK | 1.200 | 355. |
| 6 | 99 | KYGYSPRVKK | 1.200 | 356. |
| 7 | 196 | SLVKVLKTPK | 0.600 | 357. |
| 8 | 200 | VLKTPKCALK | 0.400 | 358. |
| 9 | 190 | TPPTKQSLVK | 0.400 | 359. |
| 10 | 122 | ELSNCENFQK | 0.360 | 360. |
| 11 | 386 | IAIKAVPPSK | 0.300 | 361. |
| 12 | 291 | TPGLKIPSTK | 0.200 | 362. |
| 13 | 142 | PVASSCISEK | 0.200 | 363. |
| 14 | 174 | NPPQAVNNYK | 0.200 | 364. |
| 15 | 286 | VPTFCTPGLK | 0.200 | 365. |
| 16 | 396 | RFLKHGQNIR | 0.180 | 366. |
| 17 | 348 | TISSYENLLR | 0.160 | 367. |
| 18 | 55 | KDDVNILLDK | 0.120 | 368. |
| 19 | 46 | DLHSEVQTLK | 0.120 | 369. |
| 20 | 83 | MEKNSMDIMK | 0.120 | 370. |
| 21 | 199 | KVLKTPKCAL | 0.090 | 371. |
| 22 | 185 | EPVIVTPPTK | 0.090 | 372. |
| 23 | 387 | AIKAVPPSKR | 0.080 | 373. |
| 24 | 380 | SNLATPIAIK | 0.060 | 374. |
| 25 | 57 | DVNILLDKAR | 0.060 | 375. |
| 26 | 126 | CENFQKTDVK | 0.060 | 376. |
| 27 | 232 | LNEDYTMGLK | 0.040 | 377. |
| 28 | 261 | NVFATPSPII | 0.040 | 378. |
| 29 | 76 | IKATKVLMEK | 0.040 | 379. |
| 30 | 96 | YFQKYGYSPR | 0.040 | 380. |
| 31 | 156 | PQLSDFGLER | 0.036 | 381. |
| 32 | 68 | ENQEGIDFIK | 0.036 | 382. |
| 33 | 238 | MGLKNARNNK | 0.030 | 383. |
| 34 | 216 | VTPKLEHFGI | 0.030 | 384. |
| 35 | 170 | QVLPNPPQAV | 0.030 | 385. |
| 36 | 66 | RLENQEGIDF | 0.024 | 386. |
| 37 | 235 | DYTMGLKNAR | 0.024 | 387. |
| 38 | 285 | LVPTFCTPGL | 0.020 | 388. |
| 39 | 210 | MDDFECVTPK | 0.020 | 389. |
| 40 | 1 | MDPIRSFCGK | 0.020 | 390. |
| 41 | 188 | IVTPPTKQSL | 0.020 | 391. |
| 42 | 178 | AVNNYKEEPV | 0.020 | 392. |
| 43 | 193 | TKQSLVKVLK | 0.020 | 393. |
| 44 | 42 | RILYDLHSEV | 0.018 | 394. |
| 45 | 81 | VLMEKNSMDI | 0.016 | 395. |
| 46 | 52 | QTLKDDVNIL | 0.015 | 396. |
| 47 | 16 | STLDCETARL | 0.015 | 397. |
| 48 | 85 | KNSMDIMKIR | 0.012 | 398. |
| 49 | 366 | KIPEDILQLL | 0.012 | 399. |
| 50 | 72 | GIDFIKATKV | 0.012 | 400. |

TABLE XIII (A)

HLA PEPTIDE SCORING RESULTS - 193P1E1B - A24, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 212 | DFECVTPKL | 46.200 | 401. |
| 2 | 74 | DFIKATKVL | 30.000 | 402. |
| 3 | 6 | SFCGKLRSL | 20.000 | 403. |
| 4 | 396 | RFLKHGQNI | 18.000 | 404. |
| 5 | 314 | KTNSSSNDL | 14.400 | 405. |
| 6 | 366 | KIPEDILQL | 14.400 | 406. |
| 7 | 367 | IPEDILQLL | 12.096 | 407. |
| 8 | 10 | KLRSLASTL | 9.600 | 408. |
| 9 | 35 | DFEDYPMRI | 9.000 | 409. |
| 10 | 189 | VTPPTKQSL | 8.640 | 410. |
| 11 | 39 | YPMRILYDL | 8.400 | 411. |
| 12 | 265 | TPSPIIQQL | 8.064 | 412. |
| 13 | 309 | NYPLSKTNS | 7.500 | 413. |
| 14 | 389 | KAVPPSKRF | 7.200 | 414. |
| 15 | 250 | EAIDTESRL | 7.200 | 415. |
| 16 | 390 | AVPPSKRFL | 7.200 | 416. |
| 17 | 232 | LNEDYTMGL | 7.200 | 417. |
| 18 | 101 | GYSPRVKKN | 6.600 | 418. |
| 19 | 115 | EAINSDPEL | 6.600 | 419. |
| 20 | 59 | NILLDKARL | 6.000 | 420. |
| 21 | 304 | ALVSTNYPL | 6.000 | 421. |
| 22 | 181 | NYKEEPVIV | 6.000 | 422. |
| 23 | 155 | SPQLSDFGL | 6.000 | 423. |
| 24 | 277 | DAEYTNSPL | 6.000 | 424. |
| 25 | 53 | TLKDDVNIL | 5.760 | 425. |
| 26 | 288 | TFCTPGLKI | 5.500 | 426. |
| 27 | 235 | DYTMGLKNA | 5.000 | 427. |
| 28 | 262 | VFATPSPII | 5.000 | 428. |
| 29 | 95 | EYFQKYGYS | 5.000 | 429. |
| 30 | 21 | ETARLQRAL | 4.800 | 430. |
| 31 | 46 | DLHSEVQTL | 4.800 | 431. |
| 32 | 333 | NSDTCFENL | 4.800 | 432. |
| 33 | 348 | TISSYENLL | 4.800 | 433. |
| 34 | 224 | GISEYTMCL | 4.800 | 434. |
| 35 | 89 | DIMKIREYF | 4.200 | 435. |
| 36 | 286 | VPTFCTPGL | 4.000 | 436. |
| 37 | 364 | VTKIPEDIL | 4.000 | 437. |
| 38 | 205 | KCALKMDDF | 4.000 | 438. |
| 39 | 17 | TLDCETARL | 4.000 | 439. |
| 40 | 374 | LLSKYNSNL | 4.000 | 440. |
| 41 | 200 | VLKTPKCAL | 4.000 | 441. |
| 42 | 295 | KIPSTKNSI | 3.600 | 442. |
| 43 | 244 | RNNKSEEAI | 3.000 | 443. |
| 44 | 330 | LVLNSDTCF | 3.000 | 444. |
| 45 | 281 | TNSPLVPTF | 2.880 | 445. |
| 46 | 222 | HFGISEYTM | 2.500 | 446. |
| 47 | 215 | CVTPKLEHF | 2.400 | 447. |
| 48 | 255 | ESRLNDVF | 2.400 | 448. |
| 49 | 85 | KNSMDIMKI | 2.200 | 449. |
| 50 | 28 | ALDGEESDF | 2.000 | 450. |

TABLE XIV (A)

HLA PEPTIDE SCORING RESULTS - 193P1E1B - A24, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 38 | DYPMRILYDL | 420.000 | 451. |
| 2 | 377 | KYNSNLATPI | 180.000 | 452. |
| 3 | 35 | DFEDYPMRIL | 36.000 | 453. |
| 4 | 366 | KIPEDILQLL | 24.192 | 454. |
| 5 | 165 | RYIVSQVLPN | 15.000 | 455. |
| 6 | 389 | KAVPPSKRFL | 14.400 | 456. |
| 7 | 154 | RSPQLSDFGL | 12.000 | 457. |
| 8 | 199 | KVLKTPKCAL | 12.000 | 458. |
| 9 | 264 | ATPSPIIQQL | 10.080 | 459. |
| 10 | 309 | NYPLSKTNSS | 9.000 | 460. |
| 11 | 351 | SYENLLRTPT | 9.000 | 461. |
| 12 | 101 | GYSPRVKKNS | 8.400 | 462. |
| 13 | 5 | RSFCGKLRSL | 8.000 | 463. |
| 14 | 231 | CLNEDYTMGL | 7.200 | 464. |
| 15 | 52 | QTLKDDVNIL | 7.200 | 465. |
| 16 | 27 | RALDGEESDF | 7.200 | 466. |
| 17 | 323 | EVEDRTSLVL | 7.200 | 467. |
| 18 | 16 | STLDCETARL | 7.200 | 468. |
| 19 | 53 | TLKDDVNILL | 6.720 | 469. |
| 20 | 2 | DPIRSFCGKL | 6.600 | 470. |
| 21 | 181 | NYKEEPVIVT | 6.000 | 471. |
| 22 | 321 | DLEVEDRTSL | 6.000 | 472. |
| 23 | 303 | IALVSTNYPL | 6.000 | 473. |
| 24 | 285 | LVPTFCTPGL | 6.000 | 474. |
| 25 | 223 | FGISEYTMCL | 6.000 | 475. |
| 26 | 373 | QLLSKYNSNL | 6.000 | 476. |
| 27 | 66 | RLENQEGIDF | 6.000 | 477. |
| 28 | 58 | VNILLDKARL | 6.000 | 478. |
| 29 | 227 | EYTMCLNEDY | 6.000 | 479. |
| 30 | 332 | LNSDTCFENL | 5.760 | 480. |
| 31 | 188 | IVTPPTKQSL | 5.760 | 481. |
| 32 | 129 | FQKTDVKDDL | 5.600 | 482. |
| 33 | 44 | LYDLHSEVQT | 5.000 | 483. |
| 34 | 279 | EYTNSPLVPT | 5.000 | 484. |
| 35 | 363 | EVTKIPEDIL | 4.000 | 485. |
| 36 | 296 | IPSTKNSIAL | 4.000 | 486. |
| 37 | 346 | SPTISSYENL | 4.000 | 487. |
| 38 | 74 | DFIKATKVLM | 3.750 | 488. |
| 39 | 280 | YTNSPLVPTF | 3.600 | 489. |
| 40 | 329 | SLVLNSDTCF | 3.000 | 490. |
| 41 | 214 | ECVTPKLEHF | 3.000 | 491. |
| 42 | 120 | DPELSNCENF | 3.000 | 492. |
| 43 | 64 | KARLENQEGI | 2.000 | 493. |
| 44 | 108 | KNSVHEQEAI | 2.000 | 494. |
| 45 | 152 | SPRSPQLSDF | 2.000 | 495. |
| 46 | 81 | VLMEKNSMDI | 1.800 | 496. |
| 47 | 216 | VTPKLEHFGI | 1.500 | 497. |
| 48 | 260 | DNVFATPSPI | 1.500 | 498. |
| 49 | 179 | VNNYKEEPVI | 1.500 | 499. |
| 50 | 379 | NSNLATPIAI | 1.500 | 500. |

TABLE XV (A)

HLA PEPTIDE SCORING RESULTS - 193P1E1B - B7, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 39 | YPMRILYDL | 240.000 | 501. |
| 2 | 265 | TPSPIIQQL | 80.000 | 502. |
| 3 | 155 | SPQLSDFGL | 80.000 | 503. |
| 4 | 286 | VPTFCTPGL | 80.000 | 504. |
| 5 | 390 | AVPPSKRFL | 60.000 | 505. |
| 6 | 103 | SPRVKKNSV | 40.000 | 506. |
| 7 | 10 | KLRSLASTL | 40.000 | 507. |
| 8 | 367 | IPEDILQLL | 24.000 | 508. |
| 9 | 304 | ALVSTNYPL | 12.000 | 509. |
| 10 | 250 | EAIDTESRL | 12.000 | 510. |
| 11 | 115 | EAINSDPEL | 12.000 | 511. |
| 12 | 217 | TPKLEHFGI | 8.000 | 512. |
| 13 | 140 | DPPVASSCI | 8.000 | 513. |
| 14 | 364 | VTKIPEDIL | 6.000 | 514. |
| 15 | 200 | VLKTPKCAL | 6.000 | 515. |
| 16 | 80 | KVLMEKNSM | 5.000 | 516. |
| 17 | 374 | LLSKYNSNL | 4.000 | 517. |
| 18 | 189 | VTPPTKQSL | 4.000 | 518. |
| 19 | 3 | PIRSFCGKL | 4.000 | 519. |
| 20 | 21 | ETARLQRAL | 4.000 | 520. |
| 21 | 314 | KTNSSSNDL | 4.000 | 521. |
| 22 | 366 | KIPEDILQL | 4.000 | 522. |
| 23 | 59 | NILLDKARL | 4.000 | 523. |
| 24 | 224 | GISEYTMCL | 4.000 | 524. |
| 25 | 348 | TISSYENLL | 4.000 | 525. |
| 26 | 46 | DLHSEVQTL | 4.000 | 526. |
| 27 | 190 | TPPTKQSLV | 4.000 | 527. |
| 28 | 53 | TLKDDVNIL | 4.000 | 528. |
| 29 | 277 | DAEYTNSPL | 3.600 | 529. |
| 30 | 152 | SPRSPQLSD | 3.000 | 530. |
| 31 | 283 | SPLVPTFCT | 3.000 | 531. |
| 32 | 185 | EPVIVTPPT | 2.000 | 532. |
| 33 | 363 | EVTKIPEDI | 2.000 | 533. |
| 34 | 261 | NVFATPSPI | 2.000 | 534. |
| 35 | 296 | IPSTKNSIA | 2.000 | 535. |
| 36 | 291 | TPGLKIPST | 2.000 | 536. |
| 37 | 232 | LNEDYTMGL | 1.200 | 537. |
| 38 | 17 | TLDCETARL | 1.200 | 538. |
| 39 | 333 | NSDTCFENL | 1.200 | 539. |
| 40 | 75 | FIKATKVLM | 1.000 | 540. |
| 41 | 202 | KTPKCALKM | 1.000 | 541. |
| 42 | 230 | MCLNEDYTM | 1.000 | 542. |
| 43 | 50 | EVQTLKDDV | 1.000 | 543. |
| 44 | 172 | LPNPPQAVN | 0.600 | 544. |
| 45 | 383 | ATPIAIKAV | 0.600 | 545. |
| 46 | 343 | DPSSPTISS | 0.600 | 546. |
| 47 | 322 | LEVEDRTSL | 0.600 | 547. |
| 48 | 199 | KVLKTPKCA | 0.500 | 548. |
| 49 | 57 | DVNILLDKA | 0.500 | 549. |
| 50 | 170 | QVLPNPPQA | 0.500 | 550. |

TABLE XVI (A)

HLA PEPTIDE SCORING RESULTS - 193P1E1B - B7, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 346 | SPTISSYENL | 80.000 | 551. |
| 2 | 296 | IPSTKNSIAL | 80.000 | 552. |
| 3 | 2 | DPIRSFCGKL | 80.000 | 553. |
| 4 | 199 | KVLKTPKCAL | 30.000 | 554. |
| 5 | 363 | EVTKIPEDIL | 30.000 | 555. |
| 6 | 188 | IVTPPTKQSL | 20.000 | 556. |
| 7 | 285 | LVPTFCTPGL | 20.000 | 557. |
| 8 | 389 | KAVPPSKRFL | 12.000 | 558. |
| 9 | 64 | KARLENQEGI | 12.000 | 559. |
| 10 | 264 | ATPSPIIQQL | 12.000 | 560. |
| 11 | 303 | IALVSTNYPL | 12.000 | 561. |
| 12 | 358 | TPTPPEVTKI | 8.000 | 562. |
| 13 | 323 | EVEDRTSLVL | 6.000 | 563. |
| 14 | 152 | SPRSPQLSDF | 4.000 | 564. |
| 15 | 373 | QLLSKYNSNL | 4.000 | 565. |
| 16 | 5 | RSFCGKLRSL | 4.000 | 566. |
| 17 | 53 | TLKDDVNILL | 4.000 | 567. |
| 18 | 16 | STLDCETARL | 4.000 | 568. |
| 19 | 332 | LNSDTCFENL | 4.000 | 569. |
| 20 | 129 | FQKTDVKDDL | 4.000 | 570. |
| 21 | 231 | CLNEDYTMGL | 4.000 | 571. |
| 22 | 366 | KIPEDILQLL | 4.000 | 572. |
| 23 | 58 | VNILLDKARL | 4.000 | 573. |
| 24 | 163 | LERYIVSQVL | 4.000 | 574. |
| 25 | 52 | QTLKDDVNIL | 4.000 | 575. |
| 26 | 154 | RSPQLSDFGL | 4.000 | 576. |
| 27 | 223 | FGISEYTMCL | 4.000 | 577. |
| 28 | 261 | NVFATPSPII | 3.000 | 578. |
| 29 | 242 | NARNNKSEEA | 3.000 | 579. |
| 30 | 178 | AVNNYKEEPV | 3.000 | 580. |
| 31 | 103 | SPRVKKNSVH | 2.000 | 581. |
| 32 | 355 | LLRTPTPPEV | 2.000 | 582. |
| 33 | 321 | DLEVEDRTSL | 1.800 | 583. |
| 34 | 170 | QVLPNPPQAV | 1.500 | 584. |
| 35 | 81 | VLMEKNSMDI | 1.200 | 585. |
| 36 | 255 | ESRLNDNVFA | 1.000 | 586. |
| 37 | 229 | TMCLNEDYTM | 1.000 | 587. |
| 38 | 39 | YPMRILYDLH | 0.600 | 588. |
| 39 | 382 | LATPIAIKAV | 0.600 | 589. |
| 40 | 207 | ALKMDDFECV | 0.600 | 590. |
| 41 | 197 | LVKVLKTPKC | 0.500 | 591. |
| 42 | 379 | NSNLATPIAI | 0.400 | 592. |
| 43 | 343 | DPSSPTISSY | 0.400 | 593. |
| 44 | 149 | SEKSPRSPQL | 0.400 | 594. |
| 45 | 192 | PTKQSLVKVL | 0.400 | 595. |
| 46 | 191 | PPTKQSLVKV | 0.400 | 596. |
| 47 | 51 | VQTLKDDVNI | 0.400 | 597. |
| 48 | 267 | SPIIQQLEKS | 0.400 | 598. |
| 49 | 365 | TKIPEDILQL | 0.400 | 599. |
| 50 | 249 | EEAIDTESRL | 0.400 | 600. |

TABLE XVII (A)

HLA PEPTIDE SCORING RESULTS - 193P1E1B - B35, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 174 | NPPQAVNNY | 40.000 | 601. |
| 2 | 217 | TPKLEHFGI | 36.000 | 602. |
| 3 | 92 | KIREYFQKY | 24.000 | 603. |
| 4 | 286 | VPTFCTPGL | 20.000 | 604. |
| 5 | 265 | TPSPIIQQL | 20.000 | 605. |
| 6 | 39 | YPMRILYDL | 20.000 | 606. |
| 7 | 155 | SPQLSDFGL | 20.000 | 607. |
| 8 | 255 | ESRLNDNVF | 15.000 | 608. |
| 9 | 103 | SPRVKKNSV | 12.000 | 609. |
| 10 | 367 | IPEDILQLL | 12.000 | 610. |
| 11 | 53 | TLKDDVNIL | 9.000 | 611. |
| 12 | 140 | DPPVASSCI | 8.000 | 612. |
| 13 | 366 | KIPEDILQL | 6.000 | 613. |
| 14 | 75 | FIKATKVLM | 6.000 | 614. |
| 15 | 250 | EAIDTESRL | 6.000 | 615. |
| 16 | 80 | KVLMEKNSM | 6.000 | 616. |
| 17 | 10 | KLRSLASTL | 6.000 | 617. |
| 18 | 389 | KAVPPSKRF | 6.000 | 618. |
| 19 | 33 | ESDFEDYPM | 4.500 | 619. |
| 20 | 202 | KTPKCALKM | 4.000 | 620. |
| 21 | 190 | TPPTKQSLV | 4.000 | 621. |
| 22 | 230 | MCLNEDYTM | 3.000 | 622. |
| 23 | 158 | LSDFGLERY | 3.000 | 623. |
| 24 | 200 | VLKTPKCAL | 3.000 | 624. |
| 25 | 115 | EAINSDPEL | 3.000 | 625. |
| 26 | 364 | VTKIPEDIL | 3.000 | 626. |
| 27 | 109 | NSVHEQEAI | 3.000 | 627. |
| 28 | 185 | EPVIVTPPT | 2.000 | 628. |
| 29 | 205 | KCALKMDDF | 2.000 | 629. |
| 30 | 296 | IPSTKNSIA | 2.000 | 630. |
| 31 | 302 | SIALVSTNY | 2.000 | 631. |
| 32 | 370 | DILQLLSKY | 2.000 | 632. |
| 33 | 283 | SPLVPTFCT | 2.000 | 633. |
| 34 | 224 | GISEYTMCL | 2.000 | 634. |
| 35 | 310 | YPLSKTNSS | 2.000 | 635. |
| 36 | 314 | KTNSSSNDL | 2.000 | 636. |
| 37 | 346 | SPTISSYEN | 2.000 | 637. |
| 38 | 343 | DPSSPTISS | 2.000 | 638. |
| 39 | 291 | TPGLKIPST | 2.000 | 639. |
| 40 | 228 | YTMCLNEDY | 2.000 | 640. |
| 41 | 172 | LPNPPQAVN | 2.000 | 641. |
| 42 | 375 | LSKYNSNLA | 1.500 | 642. |
| 43 | 333 | NSDTCFENL | 1.500 | 643. |
| 44 | 312 | LSKTNSSSN | 1.500 | 644. |
| 45 | 46 | DLHSEVQTL | 1.500 | 645. |
| 46 | 59 | NILLDKARL | 1.500 | 646. |
| 47 | 85 | KNSMDIMKI | 1.200 | 647. |
| 48 | 304 | ALVSTNYPL | 1.000 | 648. |
| 49 | 89 | DIMKIREYF | 1.000 | 649. |
| 50 | 189 | VTPPTKQSL | 1.000 | 650. |

TABLE XVIII (A)

HLA PEPTIDE SCORING RESULTS - 193P1E1B - B35, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 152 | SPRSPQLSDF | 60.000 | 651. |
| 2 | 343 | DPSSPTISSY | 40.000 | 652. |
| 3 | 346 | SPTISSYENL | 20.000 | 653. |
| 4 | 2 | DPIRSFCGKL | 20.000 | 654. |
| 5 | 296 | IPSTKNSIAL | 20.000 | 655. |
| 6 | 27 | RALDGEESDF | 18.000 | 656. |
| 7 | 358 | TPTPPEVTKI | 12.000 | 657. |
| 8 | 301 | NSIALVSTNY | 10.000 | 658. |
| 9 | 154 | RSPQLSDFGL | 10.000 | 659. |
| 10 | 5 | RSFCGKLRSL | 10.000 | 660. |
| 11 | 64 | KARLENQEGI | 7.200 | 661. |
| 12 | 389 | KAVPPSKRFL | 6.000 | 662. |
| 13 | 53 | TLKDDVNILL | 6.000 | 663. |
| 14 | 217 | TPKLEHFGIS | 6.000 | 664. |
| 15 | 120 | DPELSNCENF | 6.000 | 665. |
| 16 | 157 | QLSDFGLERY | 4.000 | 666. |
| 17 | 366 | KIPEDILQLL | 4.000 | 667. |
| 18 | 271 | QQLEKSDAEY | 4.000 | 668. |
| 19 | 303 | IALVSTNYPL | 3.000 | 669. |
| 20 | 16 | STLDCETARL | 3.000 | 670. |
| 21 | 229 | TMCLNEDYTM | 3.000 | 671. |
| 22 | 129 | FQKTDVKDDL | 3.000 | 672. |
| 23 | 255 | ESRLNDNVFA | 2.250 | 673. |
| 24 | 267 | SPIIQQLEKS | 2.000 | 674. |
| 25 | 332 | LNSDTCFENL | 2.000 | 675. |
| 26 | 140 | DPPVASSCIS | 2.000 | 676. |
| 27 | 231 | CLNEDYTMGL | 2.000 | 677. |
| 28 | 172 | LPNPPQAVNN | 2.000 | 678. |
| 29 | 199 | KVLKTPKCAL | 2.000 | 679. |
| 30 | 310 | YPLSKTNSSS | 2.000 | 680. |
| 31 | 379 | NSNLATPIAI | 2.000 | 681. |
| 32 | 30 | DGEESDFEDY | 1.800 | 682. |
| 33 | 58 | VNILLDKARL | 1.500 | 683. |
| 34 | 375 | LSKYNSNLAT | 1.500 | 684. |
| 35 | 52 | QTLKDDVNIL | 1.500 | 685. |
| 36 | 219 | KLEHFGISEY | 1.200 | 686. |
| 37 | 367 | IPEDILQLLS | 1.200 | 687. |
| 38 | 108 | KNSVHEQEAI | 1.200 | 688. |
| 39 | 329 | SLVLNSDTCF | 1.000 | 689. |
| 40 | 264 | ATPSPIIQQL | 1.000 | 690. |
| 41 | 102 | YSPRVKKNSV | 1.000 | 691. |
| 42 | 373 | QLLSKYNSNL | 1.000 | 692. |
| 43 | 285 | LVPTFCTPGL | 1.000 | 693. |
| 44 | 280 | YTNSPLVPTF | 1.000 | 694. |
| 45 | 223 | FGISEYTMCL | 1.000 | 695. |
| 46 | 188 | IVTPPTKQSL | 1.000 | 696. |
| 47 | 363 | EVTKIPEDIL | 1.000 | 697. |
| 48 | 214 | ECVTPKLEHF | 1.000 | 698. |
| 49 | 66 | RLENQEGIDF | 0.900 | 699. |
| 50 | 242 | NARNNKSEEA | 0.900 | 700. |

TABLE V (B)

VARIANT 2 WITH A E TO G CHANGE AT AMINO ACID PVASSCISGKSPRSPQL (SEQ ID NO: 1282) (AMINO ACIDS 142-158) HLA PEPTIDE SCORING RESULTS - 193P1E1B - A1, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 143 | VASSCISGK | 0.200 | 701. |
| 2 | 146 | SCISGKSPR | 0.100 | 702. |
| 3 | 147 | CISGKSPRS | 0.020 | 703. |
| 4 | 144 | ASSCISGKS | 0.015 | 704. |
| 5 | 150 | GKSPRSPQL | 0.010 | 705. |
| 6 | 142 | PVASSCISG | 0.005 | 706. |
| 7 | 145 | SSCISGKSP | 0.002 | 707. |
| 8 | 149 | SGKSPRSPQ | 0.000 | 708. |
| 9 | 148 | ISGKSPRSP | 0.000 | 709. |

TABLE VI (B)

VARIANT 2 WITH A E TO G CHANGE AT AMINO ACID PPVASSCISGKSPRSPQLS (SEQ ID NO: 1283) (AMINO ACIDS 141-159) HLA PEPTIDE SCORING RESULTS - 193P1E1B - A1, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 145 | SSCISGKSPR | 0.150 | 710. |
| 2 | 146 | SCISGKSPRS | 0.020 | 711. |
| 3 | 142 | PVASSCISGK | 0.020 | 712. |
| 4 | 143 | VASSCISGKS | 0.010 | 713. |
| 5 | 150 | GKSPRSPQLS | 0.005 | 714. |
| 6 | 148 | ISGKSPRSPQ | 0.002 | 715. |
| 7 | 144 | ASSCISGKSP | 0.002 | 716. |
| 8 | 141 | PPVASSCISG | 0.001 | 717. |
| 9 | 147 | CISGKSPRSP | 0.001 | 718. |
| 10 | 149 | SGKSPRSPQL | 0.001 | 719. |

TABLE VII (B): VARIANT 2 WITH A E TO G CHANGE AT AMINO ACID PVASSCISGKSPRSPQL (SEQ ID NO: 1282) (AMINO ACIDS 142-158) HLA PEPTIDE SCORING RESULTS - 193P1E1B - A2, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 150 | GKSPRSPQL | 0.030 | 720. |
| 2 | 147 | CISGKSPRS | 0.010 | 721. |
| 3 | 143 | VASSCISGK | 0.001 | 722. |
| 4 | 142 | PVASSCISG | 0.000 | 723. |
| 5 | 146 | SCISGKSPR | 0.000 | 724. |
| 6 | 145 | SSCISGKSP | 0.000 | 725. |

TABLE VII-continued (B): VARIANT 2 WITH A E TO G CHANGE AT AMINO ACID PVASSCISGKSPRSPQL (SEQ ID NO: 1282) (AMINO ACIDS 142-158) HLA PEPTIDE SCORING RESULTS - 193P1E1B - A2, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 7 | 144 | ASSCISGKS | 0.000 | 726. |
| 8 | 148 | ISGKSPRSP | 0.000 | 727. |
| 9 | 149 | SGKSPRSPQ | 0.000 | 728. |

TABLE VIII (B): VARIANT 2 WITH A E TO G CHANGE AT AMINO ACID PPVASSCISGKSPRSPQLS (SEQ ID NO: 1283) (AMINO ACIDS 141-159) HLA PEPTIDE SCORING RESULTS - 193P1E1B - A2, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 149 | SGKSPRSPQL | 0.005 | 729. |
| 2 | 146 | SCISGKSPRS | 0.000 | 730. |
| 3 | 147 | CISGKSPRSP | 0.000 | 731. |
| 4 | 143 | VASSCISGKS | 0.000 | 732. |
| 5 | 148 | ISGKSPRSPQ | 0.000 | 733. |
| 6 | 150 | GKSPRSPQLS | 0.000 | 734. |
| 7 | 144 | ASSCISGKSP | 0.000 | 735. |
| 8 | 145 | SSCISGKSPR | 0.000 | 736. |
| 9 | 142 | PVASSCISGK | 0.000 | 737. |
| 10 | 141 | PPVASSCISG | 0.000 | 738. |

TABLE IX (B): VARIANT 2 WITH A E TO G CHANGE AT AMINO ACID PVASSCISGKSPRSPQL (SEQ ID NO: 1282) (AMINO ACIDS 142-158) HLA PEPTIDE SCORING RESULTS - 193P1E1B - A3, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 143 | VASSCISGK | 0.300 | 739. |
| 2 | 146 | SCISGKSPR | 0.060 | 740. |
| 3 | 147 | CISGKSPRS | 0.006 | 741. |
| 4 | 150 | GKSPRSPQL | 0.003 | 742. |
| 5 | 142 | PVASSCISG | 0.000 | 743. |
| 6 | 144 | ASSCISGKS | 0.000 | 744. |
| 7 | 145 | SSCISGKSP | 0.000 | 745. |
| 8 | 149 | SGKSPRSPQ | 0.000 | 746. |
| 9 | 148 | ISGKSPRSP | 0.000 | 747. |

TABLE X (B): VARIANT 2 WITH A E TO G CHANGE AT AMINO ACID PPVASSCISGKSPRSPQLS (SEQ ID NO: 1283) (AMINO ACIDS 141-159) HLA PEPTIDE SCORING RESULTS - 193P1E1B - A3, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 142 | PVASSCISGK | 0.300 | 748. |
| 2 | 145 | SSCISGKSPR | 0.020 | 749. |
| 3 | 149 | SGKSPRSPQL | 0.001 | 750. |
| 4 | 146 | SCISGKSPRS | 0.001 | 751. |
| 5 | 147 | CISGKSPRSP | 0.000 | 752. |
| 6 | 150 | GKSPRSPQLS | 0.000 | 753. |
| 7 | 143 | VASSCISGKS | 0.000 | 754. |
| 8 | 148 | ISGKSPRSPQ | 0.000 | 755. |
| 9 | 141 | PPVASSCISG | 0.000 | 756. |
| 10 | 144 | ASSCISGKSP | 0.000 | 757. |

TABLE XI (B): VARIANT 2 WITH A E TO G CHANGE AT AMINO ACID PVASSCISGKSPRSPQL (SEQ ID NO: 1282) (AMINO ACIDS 142-158) HLA PEPTIDE SCORING RESULTS - 193P1E1B - A11, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 143 | VASSCISGK | 0.200 | 758. |
| 2 | 146 | SCISGKSPR | 0.060 | 759. |
| 3 | 150 | GKSPRSPQL | 0.001 | 760. |
| 4 | 147 | CISGKSPRS | 0.000 | 761. |
| 5 | 142 | PVASSCISG | 0.000 | 762. |
| 6 | 144 | ASSCISGKS | 0.000 | 763. |
| 7 | 149 | SGKSPRSPQ | 0.000 | 764. |
| 8 | 145 | SSCISGKSP | 0.000 | 765. |
| 9 | 148 | ISGKSPRSP | 0.000 | 766. |

TABLE XII (B): VARIANT 2 WITH A E TO G CHANGE AT AMINO ACID PPVASSCISGKSPRSPQLS (SEQ ID NO: 1283) (AMINO ACIDS 141-159) HLA PEPTIDE SCORING RESULTS - 193P1E1B - A11, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 142 | PVASSCISGK | 0.200 | 767. |
| 2 | 145 | SSCISGKSPR | 0.004 | 768. |
| 3 | 146 | SCISGKSPRS | 0.000 | 769. |
| 4 | 149 | SGKSPRSPQL | 0.000 | 770. |
| 5 | 143 | VASSCISGKS | 0.000 | 771. |
| 6 | 141 | PPVASSCISG | 0.000 | 772. |
| 7 | 150 | GKSPRSPQLS | 0.000 | 773. |
| 8 | 147 | CISGKSPRSP | 0.000 | 774. |
| 9 | 148 | ISGKSPRSPQ | 0.000 | 775. |
| 10 | 144 | ASSCISGKSP | 0.000 | 776. |

TABLE XIII (B): VARIANT 2 WITH A E TO G CHANGE AT AMINO ACID PVASSCISGKSPRSPQL (SEQ ID NO: 1282) (AMINO ACIDS 142-158) HLA PEPTIDE SCORING RESULTS - 193P1E1B - A24, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 150 | GKSPRSPQL | 0.480 | 777. |
| 2 | 144 | ASSCISGKS | 0.154 | 778. |
| 3 | 147 | CISGKSPRS | 0.100 | 779. |
| 4 | 146 | SCISGKSPR | 0.015 | 780. |
| 5 | 148 | ISGKSPRSP | 0.010 | 781. |
| 6 | 145 | SSCISGKSP | 0.010 | 782. |
| 7 | 149 | SGKSPRSPQ | 0.010 | 783. |
| 8 | 143 | VASSCISGK | 0.010 | 784. |
| 9 | 142 | PVASSCISG | 0.001 | 785. |

TABLE XIV (B): VARIANT 2 WITH A E TO G CHANGE AT AMINO ACID PPVASSCISGKSPRSPQLS (SEQ ID NO: 1283) (AMINO ACIDS 141-159) HLA PEPTIDE SCORING RESULTS - 193P1E1B - A24, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 149 | SGKSPRSPQL | 4.000 | 786. |
| 2 | 143 | VASSCISGKS | 0.154 | 787. |
| 3 | 146 | SCISGKSPRS | 0.150 | 788. |
| 4 | 150 | GKSPRSPQLS | 0.014 | 789. |
| 5 | 147 | CISGKSPRSP | 0.010 | 790. |
| 6 | 148 | ISGKSPRSPQ | 0.010 | 791. |
| 7 | 144 | ASSCISGKSP | 0.010 | 792. |
| 8 | 145 | SSCISGKSPR | 0.010 | 793. |
| 9 | 141 | PPVASSCISG | 0.002 | 794. |
| 10 | 142 | PVASSCISGK | 0.001 | 795. |

TABLE XV (B): VARIANT 2 WITH A E TO G CHANGE AT AMINO ACID PVASSCISGKSPRSPQL (SEQ ID NO: 1282) (AMINO ACIDS 142-158) HLA PEPTIDE SCORING RESULTS - 193P1E1B - B7, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 150 | GKSPRSPQL | 0.400 | 796. |
| 2 | 144 | ASSCISGKS | 0.060 | 797. |
| 3 | 143 | VASSCISGK | 0.030 | 798. |
| 4 | 149 | SGKSPRSPQ | 0.023 | 799. |
| 5 | 147 | CISGKSPRS | 0.020 | 800. |
| 6 | 145 | SSCISGKSP | 0.010 | 801. |
| 7 | 148 | ISGKSPRSP | 0.010 | 802. |
| 8 | 146 | SCISGKSPR | 0.010 | 803. |
| 9 | 142 | PVASSCISG | 0.005 | 804. |

TABLE XVI (B): VARIANT 2 WITH A E TO G CHANGE AT AMINO ACID PPVASSCISGKSPRSPQLS (SEQ ID NO: 1283) (AMINO ACIDS 141-159) HLA PEPTIDE SCORING RESULTS - 193P1E1B - B7, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 149 | SGKSPRSPQL | 4.000 | 805. |
| 2 | 143 | VASSCISGKS | 0.060 | 806. |
| 3 | 144 | ASSCISGKSP | 0.030 | 807. |
| 4 | 148 | ISGKSPRSPQ | 0.023 | 808. |
| 5 | 146 | SCISGKSPRS | 0.020 | 809. |
| 6 | 141 | PPVASSCISG | 0.020 | 810. |
| 7 | 147 | CISGKSPRSP | 0.010 | 811. |
| 8 | 145 | SSCISGKSPR | 0.010 | 812. |
| 9 | 142 | PVASSCISGK | 0.005 | 813. |
| 10 | 150 | GKSPRSPQLS | 0.002 | 814. |

TABLE XVII (B)

VARIANT 2 WITH A E TO G CHANGE AT AMINO ACID PVASSCISGKSPRSPQL (SEQ ID NO: 1282) (AMINO ACIDS 142-158) HLA PEPTIDE SCORING RESULTS - 193P1E1B - B35, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 144 | ASSCISGKS | 0.500 | 815. |
| 2 | 150 | GKSPRSPQL | 0.100 | 816. |
| 3 | 147 | CISGKSPRS | 0.100 | 817. |
| 4 | 148 | ISGKSPRSP | 0.050 | 818. |
| 5 | 145 | SSCISGKSP | 0.050 | 819. |
| 6 | 143 | VASSCISGK | 0.030 | 820. |
| 7 | 149 | SGKSPRSPQ | 0.030 | 821. |
| 8 | 146 | SCISGKSPR | 0.010 | 822. |
| 9 | 142 | PVASSCISG | 0.001 | 823. |

TABLE XVIII (B)

VARIANT 2 WITH A E TO G CHANGE AT AMINO ACID PPVASSCISGKSPRSPQLS
(SEQ ID NO: 1283) (AMINO ACIDS 141-159)
HLA PEPTIDE SCORING RESULTS - 193P1E1B - B35, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 149 | SGKSPRSPQL | 3.000 | 824. |
| 2 | 143 | VASSCISGKS | 0.300 | 825. |
| 3 | 146 | SCISGKSPRS | 0.100 | 826. |
| 4 | 148 | ISGKSPRSPQ | 0.050 | 827. |
| 5 | 145 | SSCISGKSPR | 0.050 | 828. |
| 6 | 144 | ASSCISGKSP | 0.050 | 829. |
| 7 | 141 | PPVASSCISG | 0.020 | 830. |
| 8 | 150 | GKSPRSPQLS | 0.010 | 831. |
| 9 | 147 | CISGKSPRSP | 0.010 | 832. |
| 10 | 142 | PVASSCISGK | 0.001 | 833. |

TABLE V (C)

HLA PEPTIDE SCORING RESULTS - A1, 9-MERS - 193P1E1B - VARIANT 3,
AMINO ACIDS 246-262 (NKSEEAIDAESRLNDNV (SEQ ID NO: 1284))
CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 253 | DAESRLNDN | 0.900 | 834. |
| 2 | 251 | AIDAESRLN | 0.500 | 835. |
| 3 | 247 | KSEEAIDAE | 0.135 | 836. |
| 4 | 248 | SEEAIDAES | 0.090 | 837. |
| 5 | 250 | EAIDAESRL | 0.010 | 838. |
| 6 | 249 | EEAIDAESR | 0.005 | 839. |
| 7 | 246 | NKSEEAIDA | 0.003 | 840. |
| 8 | 252 | IDAESRLND | 0.000 | 841. |
| 9 | 254 | AESRLNDNV | 0.000 | 842. |

TABLE VI (C)

HLA PEPTIDE SCORING RESULTS - A1, 10-MERS - 193P1E1B - VARIANT 3,
AMINO ACIDS 245-262 (NNKSEEAIDAESRLNDNV (SEQ ID NO: 1285))
CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 247 | KSEEAIDAES | 2.700 | 843. |
| 2 | 253 | DAESRLNDNV | 0.900 | 844. |
| 3 | 248 | SEEAIDAESR | 0.450 | 845. |
| 4 | 251 | AIDAESRLND | 0.250 | 846. |
| 5 | 250 | EAIDAESRLN | 0.010 | 847. |
| 6 | 245 | NNKSEEAIDA | 0.001 | 848. |
| 7 | 252 | IDAESRLNDN | 0.001 | 849. |
| 8 | 249 | EEAIDAESRL | 0.001 | 850. |
| 9 | 246 | NKSEEAIDAE | 0.000 | 851. |

TABLE VII (C)

HLA PEPTIDE SCORING RESULTS - A2, 9-MERS - 193P1E1B - VARIANT 3, AMINO ACIDS
246-262 (NKSEEAIDAESRLNDNV (SEQ ID NO: 1284)) CONTAINING A T TO
A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 254 | AESRLNDNV | 0.663 | 852. |
| 2 | 250 | EAIDAESRL | 0.091 | 853. |
| 3 | 246 | NKSEEAIDA | 0.028 | 854. |

TABLE VII (C)-continued

HLA PEPTIDE SCORING RESULTS - A2, 9-MERS - 193P1E1B - VARIANT 3, AMINO ACIDS 246-262 (NKSEEAIDAESRLNDNV (SEQ ID NO: 1284)) CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 4 | 251 | AIDAESRLN | 0.001 | 855. |
| 5 | 252 | IDAESRLND | 0.000 | 856. |
| 6 | 247 | KSEEAIDAE | 0.000 | 857. |
| 7 | 248 | SEEAIDAES | 0.000 | 858. |
| 8 | 253 | DAESRLNDN | 0.000 | 859. |
| 9 | 249 | EEAIDAESR | 0.000 | 860. |

TABLE VIII (C)

HLA PEPTIDE SCORING RESULTS - A2, 10-MERS - 193P1E1B - VARIANT 3, AMINO ACIDS 245-262 (NNKSEEAIDAESRLNDNV (SEQ ID NO: 1285)) CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 249 | EEAIDAESRL | 0.031 | 861. |
| 2 | 253 | DAESRLNDNV | 0.002 | 862. |
| 3 | 252 | IDAESRLNDN | 0.002 | 863. |
| 4 | 245 | NNKSEEAIDA | 0.001 | 864. |
| 5 | 251 | AIDAESRLND | 0.001 | 865. |
| 6 | 247 | KSEEAIDAES | 0.000 | 866. |
| 7 | 246 | NKSEEAIDAE | 0.000 | 867. |
| 8 | 250 | EAIDAESRLN | 0.000 | 868. |
| 9 | 248 | SEEAIDAESR | 0.000 | 869. |

TABLE IX (C)

HLA PEPTIDE SCORING RESULTS - A3, 9-MERS - 193P1E1B - VARIANT 3, AMINO ACIDS 246-262 (NKSEEAIDAESRLNDNV) (SEQ ID NO: 1284) CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 249 | EEAIDAESR | 0.004 | 870. |
| 2 | 250 | EAIDAESRL | 0.003 | 871. |
| 3 | 247 | KSEEAIDAE | 0.001 | 872. |
| 4 | 246 | NKSEEAIDA | 0.001 | 873. |
| 5 | 254 | AESRLNDNV | 0.001 | 874. |
| 6 | 251 | AIDAESRLN | 0.000 | 875. |
| 7 | 248 | SEEAIDAES | 0.000 | 876. |
| 8 | 253 | DAESRLNDN | 0.000 | 877. |
| 9 | 252 | IDAESRLND | 0.000 | 878. |

TABLE X (C)

HLA PEPTIDE SCORING RESULTS - A3, 10-MERS - 193P1E1B - VARIANT 3, AMINO ACIDS 245-262 (NNKSEEAIDAESRLNDNV (SEQ ID NO: 1285)) CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 248 | SEEAIDAESR | 0.012 | 879. |
| 2 | 251 | AIDAESRLND | 0.004 | 880. |
| 3 | 247 | KSEEAIDAES | 0.001 | 881. |
| 4 | 245 | NNKSEEAIDA | 0.001 | 882. |
| 5 | 253 | DAESRLNDNV | 0.001 | 883. |
| 6 | 249 | EEAIDAESRL | 0.001 | 884. |
| 7 | 252 | IDAESRLNDN | 0.000 | 885. |

TABLE X (C)-continued

HLA PEPTIDE SCORING RESULTS - A3, 10-MERS - 193P1E1B - VARIANT 3, AMINO ACIDS 245-262 (NNKSEEAIDAESRLNDNV (SEQ ID NO: 1285)) CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 8 | 246 | NKSEEAIDAE | 0.000 | 886. |
| 9 | 250 | EAIDAESRLN | 0.000 | 887. |

TABLE XI (C)

HLA PEPTIDE SCORING RESULTS - A11, 9-MERS - 193P1E1B - VARIANT 3, AMINO ACIDS 246-262 (NKSEEAIDAESRLNDNV (SEQ ID NO: 1284)) CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 249 | EEAIDAESR | 0.004 | 888. |
| 2 | 250 | EAIDAESRL | 0.001 | 889. |
| 3 | 254 | AESRLNDNV | 0.001 | 890. |
| 4 | 246 | NKSEEAIDA | 0.000 | 891. |
| 5 | 247 | KSEEAIDAE | 0.000 | 892. |
| 6 | 253 | DAESRLNDN | 0.000 | 893. |
| 7 | 248 | SEEAIDAES | 0.000 | 894. |
| 8 | 252 | IDAESRLND | 0.000 | 895. |
| 9 | 251 | AIDAESRLN | 0.000 | 896. |

TABLE XII (C)

HLA PEPTIDE SCORING RESULTS - A11, 10-MERS - 193P1E1B - VARIANT 3, AMINO ACIDS 245-262 (NNKSEEAIDAESRLNDNV (SEQ ID NO: 1285)) CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 248 | SEEAIDAESR | 0.012 | 897. |
| 2 | 245 | NNKSEEAIDA | 0.001 | 898. |
| 3 | 251 | AIDAESRLND | 0.001 | 899. |
| 4 | 253 | DAESRLNDNV | 0.001 | 900. |
| 5 | 249 | EEAIDAESRL | 0.000 | 901. |
| 6 | 247 | KSEEAIDAES | 0.000 | 902. |
| 7 | 252 | IDAESRLNDN | 0.000 | 903. |
| 8 | 246 | NKSEEAIDAE | 0.000 | 904. |
| 9 | 250 | EAIDAESRLN | 0.000 | 905. |

TABLE XIII (C): HLA PEPTIDE SCORING RESULTS - A24, 9-MERS - 193P1E1B-VARIANT 3, AMINO ACIDS 246-262 (NKSEEAIDAESRLNDNV (SEQ ID NO: 1284)) CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 250 | EAIDAESRL | 7.200 | 906. |
| 2 | 253 | DAESRLNDN | 0.180 | 907. |
| 3 | 251 | AIDAESRLN | 0.100 | 908. |
| 4 | 247 | KSEEAIDAE | 0.036 | 909. |
| 5 | 248 | SEEAIDAES | 0.023 | 910. |
| 6 | 254 | AESRLNDNV | 0.012 | 911. |
| 7 | 246 | NKSEEAIDA | 0.012 | 912. |
| 8 | 252 | IDAESRLND | 0.001 | 913. |
| 9 | 249 | EEAIDAESR | 0.001 | 914. |

TABLE XIV (C): HLA PEPTIDE SCORING RESULTS - A24, 10-MERS - 193P1E1B-VARIANT 3,
AMINO ACIDS 245-262 (NNKSEEAIDAESRLNDNV (SEQ ID NO: 1285))
CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 247 | KSEEAIDAES | 0.554 | 915. |
| 2 | 249 | EEAIDAESRL | 0.400 | 916. |
| 3 | 253 | DAESRLNDNV | 0.180 | 917. |
| 4 | 250 | EAIDAESRLN | 0.180 | 918. |
| 5 | 245 | NNKSEEAIDA | 0.100 | 919. |
| 6 | 252 | IDAESRLNDN | 0.014 | 920. |
| 7 | 251 | AIDAESRLND | 0.010 | 921. |
| 8 | 248 | SEEAIDAESR | 0.002 | 922. |
| 9 | 246 | NKSEEAIDAE | 0.001 | 923. |

TABLE XV (C): HLA PEPTIDE SCORING RESULTS - B7, 9-MERS - 193P1E1B-VARIANT 3,
AMINO ACIDS 246-262 (NKSEEAIDAESRLNDNV (SEQ ID NO: 1284))
CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 250 | EAIDAESRL | 12.000 | 924. |
| 2 | 254 | AESRLNDNV | 0.060 | 925. |
| 3 | 251 | AIDAESRLN | 0.018 | 926. |
| 4 | 253 | DAESRLNDN | 0.018 | 927. |
| 5 | 246 | NKSEEAIDA | 0.010 | 928. |
| 6 | 247 | KSEEAIDAE | 0.003 | 929. |
| 7 | 252 | IDAESRLND | 0.002 | 930. |
| 8 | 249 | EEAIDAESR | 0.001 | 931. |
| 9 | 248 | SEEAIDAES | 0.001 | 932. |

TABLE XVI (C): HLA PEPTIDE SCORING RESULTS-B7, 10-MERS - 193P1E1B-VARIANT 3,
AMINO ACIDS 245-262 (NNKSEEAIDAESRLNDNV (SEQ ID NO: 1285))
CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 249 | EEAIDAESRL | 0.400 | 933. |
| 2 | 253 | DAESRLNDNV | 0.180 | 934. |
| 3 | 245 | NNKSEEAIDA | 0.100 | 935. |
| 4 | 250 | EAIDAESRLN | 0.060 | 936. |
| 5 | 251 | AIDAESRLND | 0.013 | 937. |
| 6 | 247 | KSEEAIDAES | 0.006 | 938. |
| 7 | 252 | IDAESRLNDN | 0.002 | 939. |
| 8 | 246 | NKSEEAIDAE | 0.001 | 940. |
| 9 | 248 | SEEAIDAESR | 0.000 | 941. |

TABLE XVII (C): HLA PEPTIDE SCORING RESULTS - B35, 9-MERS - 193P1E1B-VARIANT 3,
AMINO ACIDS 246-262 (NKSEEAIDAESRLNDNV (SEQ ID NO: 1284))
CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 250 | EAIDAESRL | 6.000 | 942. |
| 2 | 253 | DAESRLNDN | 0.090 | 943. |
| 3 | 247 | KSEEAIDAE | 0.060 | 944. |
| 4 | 251 | AIDAESRLN | 0.045 | 945. |

TABLE XVII-continued (C): HLA PEPTIDE SCORING RESULTS - B35, 9-MERS - 193P1E1B-VARIANT 3,
AMINO ACIDS 246-262 (NKSEEAIDAESRLNDNV (SEQ ID NO: 1284))
CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 5 | 246 | NKSEEAIDA | 0.030 | 946. |
| 6 | 254 | AESRLNDNV | 0.020 | 947. |
| 7 | 248 | SEEAIDAES | 0.003 | 948. |
| 8 | 252 | IDAESRLND | 0.002 | 949. |
| 9 | 249 | EEAIDAESR | 0.002 | 950. |

TABLE XVIII (C): HLA PEPTIDE SCORING RESULTS - B35, 10-MERS - 193P1E1B-VARIANT 3,
AMINO ACIDS 245-262 (NNKSEEAIDAESRLNDNV (SEQ ID NO: 1285))
CONTAINING A T TO A CHANGE AT AMINO ACID 254

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 250 | EAIDAESRLN | 0.900 | 951. |
| 2 | 247 | KSEEAIDAES | 0.600 | 952. |
| 3 | 245 | NNKSEEAIDA | 0.450 | 953. |
| 4 | 253 | DAESRLNDNV | 0.180 | 954. |
| 5 | 249 | EEAIDAESRL | 0.100 | 955. |
| 6 | 252 | IDAESRLNDN | 0.020 | 956. |
| 7 | 251 | AIDAESRLND | 0.003 | 957. |
| 8 | 246 | NKSEEAIDAE | 0.002 | 958. |
| 9 | 248 | SEEAIDAESR | 0.000 | 959. |

TABLE V (D): Variant 4 and 5 {Splice variants 2 and 3 encode up to amino acid 373 then adds 15
new amino acids (underlined)} KIPEDILQKFQWIYPTQKLNKMR
(SEQ ID NO: 1286) (amino acids 366-373 to 374* -388*)
HLA PEPTIDE SCORING RESULTS - 193P1E1B - A1, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 367 | IPEDILQKF | 2.250 | 960. |
| 2 | 366 | KIPEDILQK | 1.000 | 961. |
| 3 | 377 | WIYPTQKLN | 0.100 | 962. |
| 4 | 378 | IYPTQKLNK | 0.050 | 963. |
| 5 | 371 | ILQKFQWIY | 0.050 | 964. |
| 6 | 370 | DILQKFQWI | 0.010 | 965. |
| 7 | 375 | FQWIYPTQK | 0.003 | 966. |
| 8 | 368 | PEDILQKFQ | 0.003 | 967. |
| 9 | 380 | PTQKLNKMR | 0.003 | 968. |
| 10 | 369 | EDILQKFQW | 0.003 | 969. |
| 11 | 379 | YPTQKLNKM | 0.003 | 970. |
| 12 | 373 | QKFQWIYPT | 0.001 | 971. |
| 13 | 374 | KFQWIYPTQ | 0.001 | 972. |
| 14 | 376 | QWIYPTQKL | 0.001 | 973. |
| 15 | 372 | LQKFQWIYP | 0.000 | 974. |

TABLE VI (D): Variant 4 and 5 {Splice variants 2 and 3 encode up to amino acid 373 then adds 15 new amino acids (underlined)} TKIPEDILQKFQWIYPTQKLNKMR (SEQ ID NO: 1287) (amino acids 365-373 to 374*-388*) HLA PEPTIDE SCORING RESULTS - 193P1E1B - A1, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 377 | WIYPTQKLNK | 10.000 | 975. |
| 2 | 365 | TKIPEDILQK | 0.500 | 976. |
| 3 | 370 | DILQKFQWIY | 0.500 | 977. |
| 4 | 367 | IPEDILQKFQ | 0.225 | 978. |
| 5 | 366 | KIPEDILQKF | 0.100 | 979. |
| 6 | 379 | YPTQKLNKMR | 0.025 | 980. |
| 7 | 368 | PEDILQKFQW | 0.013 | 981. |
| 8 | 374 | KFQWIYPTQK | 0.010 | 982. |
| 9 | 373 | QKFQWIYPTQ | 0.001 | 983. |
| 10 | 371 | ILQKFQWIYP | 0.001 | 984. |
| 11 | 378 | IYPTQKLNKM | 0.001 | 985. |
| 12 | 376 | QWIYPTQKLN | 0.001 | 986. |
| 13 | 369 | EDILQKFQWI | 0.001 | 987. |
| 14 | 372 | LQKFQWTYPT | 0.000 | 988. |
| 15 | 375 | FQWIYPTQKL | 0.000 | 989. |

TABLE VII (D): Variant 4 and 5 {Splice variants 2 and 3 encode up to amino acid 373 then adds 15 new amino acids (underlined)} KIPEDILQKFQWIYPTQKLNKMR (SEQ ID NO: 1286) (amino acids 366-373 to 374*-388*) HLA PEPTIDE SCORING RESULTS - 193P1E1B - A2, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 370 | DILQKFQWI | 4.160 | 990. |
| 2 | 371 | ILQKFQWIY | 1.480 | 991. |
| 3 | 379 | YPTQKLNKM | 0.343 | 992. |
| 4 | 377 | WIYPTQKLN | 0.151 | 993. |
| 5 | 373 | QKFQWIYPT | 0.088 | 994. |
| 6 | 366 | KIPEDILQK | 0.068 | 995. |
| 7 | 375 | FQWIYPTQK | 0.058 | 996. |
| 8 | 376 | QWIYPTQKL | 0.003 | 997. |
| 9 | 372 | LQKFQWIYP | 0.001 | 998. |
| 10 | 367 | IPEDILQKF | 0.000 | 999. |
| 11 | 374 | KFQWIYPTQ | 0.000 | 1000. |
| 12 | 369 | EDILQKFQW | 0.000 | 1001. |
| 13 | 368 | PEDILQKFQ | 0.000 | 1002. |
| 14 | 380 | PTQKLNKMR | 0.000 | 1003. |
| 15 | 378 | IYPTQKLNK | 0.000 | 1004. |

TABLE VIII (D): Variant 4 and 5 {Splice variants 2 and 3 encode up to amino acid 373 then adds 15 new amino acids (underlined)} TKIPEDILQKFQWIYPTQKLNKMR (SEQ ID NO: 1287) amino acids 365-373 to 374*-388) HLA PEPTIDE SCORING RESULTS - 193P1E1B - A2, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 375 | FQWIYPTQKL | 82.694 | 1005. |
| 2 | 366 | KIPEDILQKF | 0.338 | 1006. |
| 3 | 371 | ILQKFQWIYP | 0.237 | 1007. |
| 4 | 372 | LQKFQWIYPT | 0.103 | 1008. |
| 5 | 370 | DILQKFQWIY | 0.033 | 1009. |
| 6 | 377 | WIYPTQKLNK | 0.030 | 1010. |
| 7 | 369 | EDILQKFQWI | 0.011 | 1011. |
| 8 | 378 | IYPTQKLNKM | 0.003 | 1012. |
| 9 | 379 | YPTQKLNKMR | 0.000 | 1013. |
| 10 | 367 | IPEDILQKFQ | 0.000 | 1014. |
| 11 | 373 | QKFQWIYPTQ | 0.000 | 1015. |

TABLE VIII-continued (D): Variant 4 and 5 {Splice variants 2 and 3 encode up to amino acid 373 then adds 15 new amino acids (underlined)} TKIPEDIL<u>QKFQWIYPTQKLNKMR</u> (SEQ ID NO: 1287) amino acids 365-373 to 374*-388) HLA PEPTIDE SCORING RESULTS - 193P1E1B - A2, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 12 | 368 | PEDILQKFQW | 0.000 | 1016. |
| 13 | 365 | TKIPEDILQK | 0.000 | 1017. |
| 14 | 374 | KFQWIYPTQK | 0.000 | 1018. |
| 15 | 376 | QWIYPTQKLN | 0.000 | 1019. |

TABLE IX (D)

Variant 4 and 5 {Splice variants 2 and 3 encode up to amino acid 373 then adds 15 new amino acids (underlined)} KIPEDIL<u>QKFQWIYPTQKLNKMR</u> (SEQ ID NO: 1286) (amino acids 366-373 to 374*-388*) HLA PEPTIDE SCORING RESULTS - 193P1E1B - A3, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 371 | ILQKFQWIY | 36.000 | 1020. |
| 2 | 366 | KIPEDILQK | 27.000 | 1021. |
| 3 | 375 | FQWIYPTQK | 9.000 | 1022. |
| 4 | 370 | DILQKFQWI | 0.081 | 1023. |
| 5 | 367 | IPEDILQKF | 0.045 | 1024. |
| 6 | 378 | IYPTQKLNK | 0.040 | 1025. |
| 7 | 380 | PTQKLNKMR | 0.010 | 1026. |
| 8 | 377 | WIYPTQKLN | 0.007 | 1027. |
| 9 | 373 | QKFQWIYPT | 0.007 | 1028. |
| 10 | 379 | YPTQKLNKM | 0.003 | 1029. |
| 11 | 376 | QWIYPTQKL | 0.001 | 1030. |
| 12 | 372 | LQKFQWIYP | 0.001 | 1031. |
| 13 | 369 | EDILQKFQW | 0.000 | 1032. |
| 14 | 374 | KFQWIYPTQ | 0.000 | 1033. |
| 15 | 368 | PEDILQKFQ | 0.000 | 1034. |

TABLE X (D)

Variant 4 and 5 {Splice variants 2 and 3 encode up to amino acid 373 then adds 15 new amino acids (underlined)} TKIPEDIL<u>QKFQWIYPTQKLNKMR</u> (SEQ ID NO: 1287) (amino acids 365-373 to 374*-388*) HLA PEPTIDE SCORING RESULTS - 193P1E1B - A3, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 377 | WIYPTQKLNK | 30.000 | 1035. |
| 2 | 366 | KIPEDILQKF | 2.025 | 1036. |
| 3 | 370 | DILQKFQWIY | 1.620 | 1037. |
| 4 | 374 | KFQWIYPTQK | 0.180 | 1038. |
| 5 | 365 | TKIPEDILQK | 0.135 | 1039. |
| 6 | 375 | FQWIYPTQKL | 0.135 | 1040. |
| 7 | 372 | LQKFQWIYPT | 0.041 | 1041. |
| 8 | 371 | ILQKFQWIYP | 0.040 | 1042. |
| 9 | 379 | YPTQKLNKMR | 0.020 | 1043. |
| 10 | 369 | EDILQKFQWI | 0.001 | 1044. |
| 11 | 378 | IYPTQKLNKM | 0.000 | 1045. |
| 12 | 368 | PEDILQKFQW | 0.000 | 1046. |
| 13 | 373 | QKFQWIYPTQ | 0.000 | 1047. |
| 14 | 367 | IPEDILQKFQ | 0.000 | 1048. |
| 15 | 376 | QWIYPTQKLN | 0.000 | 1049. |

TABLE XI (D)

Variant 4 and 5 {Splice variants 2 and 3 encode up to amino acid 373 then adds 15 new amino acids (underlined)} KIPEDIL<u>QKFQWIYPTQKLNKMR</u> (SEQ ID NO: 1286) (amino acids 366-373 to 374*-388*) HLA PEPTIDE SCORING RESULTS - 193P1E1B - A11, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 366 | KIPEDILQK | 2.400 | 1050. |
| 2 | 375 | FQWIYPTQK | 1.200 | 1051. |
| 3 | 378 | IYPTQKLNK | 0.800 | 1052. |
| 4 | 380 | PTQKLNKMR | 0.010 | 1053. |
| 5 | 371 | ILQKFQWIY | 0.008 | 1054. |
| 6 | 379 | YPTQKLNKM | 0.002 | 1055. |
| 7 | 367 | IPEDILQKF | 0.002 | 1056. |
| 8 | 370 | DILQKFQWI | 0.002 | 1057. |
| 9 | 372 | LQKFQWIYP | 0.001 | 1058. |
| 10 | 374 | KFQWIYPTQ | 0.001 | 1059. |

TABLE XI (D)-continued

Variant 4 and 5 {Splice variants 2
and 3 encode up to amino acid 373 then adds 15 new amino acids
(underlined)} KIPEDILQKFQWIYPTQKLNKMR
(SEQ ID NO: 1286)
(amino acids 366-373 to 374*-388*) HLA
PEPTIDE SCORING RESULTS - 193P1E1B - A11, 9-MERS

| RANK | START PO-SITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 11 | 377 | WIYPTQKLN | 0.000 | 1060. |
| 12 | 376 | QWIYPTQKL | 0.000 | 1061. |
| 13 | 369 | EDILQKFQW | 0.000 | 1062. |
| 14 | 373 | QKFQWIYPT | 0.000 | 1063. |
| 15 | 368 | PEDILQKFQ | 0.000 | 1064. |

TABLE XII (D)

Variant 4 and 5 {Splice variants 2
and 3 encode up to amino acid 373 then adds 15 new amino acids
(underlined)} TKIPEDILQKFQWIYPTQKLNKMR
(SEQ ID NO: 1287)
(amino acids 365-373 to 374*-388*) HLA
PEPTIDE SCORING RESULTS - 193P1E1B - A11, 10-MERS

| RANK | START PO-SITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 377 | WIYPTQKLNK | 1.600 | 1065. |
| 2 | 374 | KFQWIYPTQK | 0.600 | 1066. |
| 3 | 365 | TKIPEDILQK | 0.060 | 1067. |
| 4 | 379 | YPTQKLNKMR | 0.020 | 1068. |
| 5 | 366 | KIPEDILQKF | 0.012 | 1069. |
| 6 | 375 | FQWIYPTQKL | 0.012 | 1070. |
| 7 | 378 | IYPTQKLNKM | 0.004 | 1071. |
| 8 | 370 | DILQKFQWIY | 0.004 | 1072. |
| 9 | 372 | LQKFQWIYPT | 0.001 | 1073. |
| 10 | 371 | ILQKFQWIYP | 0.001 | 1074. |
| 11 | 368 | PEDILQKFQW | 0.000 | 1075. |
| 12 | 367 | IPEDILQKFQ | 0.000 | 1076. |
| 13 | 369 | EDILQKFQWI | 0.000 | 1077. |
| 14 | 373 | QKFQWIYPTQ | 0.000 | 1078. |
| 15 | 376 | QWIYPTQKLN | 0.000 | 1079. |

TABLE XIII (D)

Variant 4 and 5 {Splice variants 2
and 3 encode up to amino acid 373 then adds 15 new amino acids
(underlined)} KIPEDILQKFQWIYPTQKLNKMR
(SEQ ID NO: 1286)
(amino acids 366-373 to 374*-388*) HLA
PEPTIDE SCORING RESULTS - 193P1E1B - A24, 9-MERS

| RANK | START PO-SITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 376 | QWIYPTQKL | 7.920 | 1080. |
| 2 | 367 | IPEDILQKF | 6.653 | 1081. |
| 3 | 370 | DILQKFQWI | 2.160 | 1082. |
| 4 | 378 | IYPTQKLNK | 0.750 | 1083. |
| 5 | 379 | YPTQKLNKM | 0.660 | 1084. |
| 6 | 374 | KFQWIYPTQ | 0.210 | 1085. |
| 7 | 371 | ILQKFQWIY | 0.150 | 1086. |
| 8 | 377 | WIYPTQKLN | 0.120 | 1087. |
| 9 | 366 | KIPEDILQK | 0.036 | 1088. |
| 10 | 369 | EDILQKFQW | 0.015 | 1089. |
| 11 | 372 | LQKFQWIYP | 0.010 | 1090. |
| 12 | 373 | QKFQWIYPT | 0.010 | 1091. |
| 13 | 375 | FQWIYPTQK | 0.010 | 1092. |
| 14 | 380 | PTQKLNKMR | 0.002 | 1093. |
| 15 | 368 | PEDILQKFQ | 0.000 | 1094. |

TABLE XIV (D)

Variant 4 and 5 {Splice variants 2
and 3 encode up to amino acid 373 then adds 15 new amino acids
(underlined)} TKIPEDILQKFQWIYPTQKLNKMR
(SEQ ID NO: 1287)
(amino acids 365-373 to 374*-388*) HLA
PEPTIDE SCORING RESULTS - 193P1E1B - A24, 10-MERS

| RANK | START PO-SITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 378 | IYPTQKLNKM | 49.500 | 1095. |
| 2 | 366 | KIPEDILQKF | 13.306 | 1096. |
| 3 | 375 | FQWIYPTQKL | 5.280 | 1097. |
| 4 | 369 | EDILQKFQWI | 0.216 | 1098. |
| 5 | 374 | KFQWIYPTQK | 0.150 | 1099. |
| 6 | 370 | DILQKFQWIY | 0.150 | 1100. |
| 7 | 376 | QWIYPTQKLN | 0.150 | 1101. |
| 8 | 372 | LQKFQWIYPT | 0.100 | 1102. |
| 9 | 367 | IPEDILQKFQ | 0.022 | 1103. |
| 10 | 371 | ILQKFQWIYP | 0.015 | 1104. |
| 11 | 379 | YPTQKLNKMR | 0.012 | 1105. |
| 12 | 377 | WIYPTQKLNK | 0.012 | 1106. |
| 13 | 365 | TKIPEDILQK | 0.002 | 1107. |
| 14 | 373 | QKFQWIYPTQ | 0.001 | 1108. |
| 15 | 368 | PEDILQKFQW | 0.001 | 1109. |

TABLE XV (D)

Variant 4 and 5 {Splice variants 2
and 3 encode up to amino acid 373 then adds 15 new amino acids
(underlined)} KIPEDIL<u>QKFQWIYPTQKLNKMR</u>
(SEQ ID NO: 1286)
(amino acids 366-373 to 374*-388*) HLA
PEPTIDE SCORING RESULTS - 193P1E1B - B7, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 379 | YPTQKLNKM | 20.000 | 1110. |
| 2 | 376 | QWIYPTQKL | 0.600 | 1111. |
| 3 | 370 | DILQKFQWI | 0.400 | 1112. |
| 4 | 367 | IPEDILQKF | 0.120 | 1113. |
| 5 | 377 | WIYPTQKLN | 0.020 | 1114. |
| 6 | 371 | ILQKFQWIY | 0.020 | 1115. |
| 7 | 373 | QKFQWIYPT | 0.010 | 1116. |
| 8 | 372 | LQKFQWIYP | 0.010 | 1117. |
| 9 | 375 | FQWIYPTQK | 0.010 | 1118. |
| 10 | 366 | KIPEDILQK | 0.010 | 1119. |
| 11 | 369 | EDILQKFQW | 0.002 | 1120. |
| 12 | 378 | IYPTQKLNK | 0.001 | 1121. |
| 13 | 380 | PTQKLNKMR | 0.001 | 1122. |
| 14 | 374 | KFQWIYPTQ | 0.001 | 1123. |
| 15 | 368 | PEDILQKFQ | 0.000 | 1124. |

TABLE XVI (D)

Variant 4 and 5 {Splice variants 2
and 3 encode up to amino acid 373 then adds 15 new amino acids
(underlined)} TKIPEDIL<u>QKFQWIYPTQKLNKMR</u>
(SEQ ID NO: 1287)
(amino acids 365-373 to 374*-388*) HLA
PEPTIDE SCORING RESULTS - 193P1E1B - B7, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 375 | FQWIYPTQKL | 6.000 | 1125. |
| 2 | 379 | YPTQKLNKMR | 0.200 | 1126. |
| 3 | 378 | IYPTQKLNKM | 0.100 | 1127. |
| 4 | 372 | LQKFQWIYPT | 0.100 | 1128. |
| 5 | 367 | IPEDILQKFQ | 0.060 | 1129. |
| 6 | 369 | EDILQKFQWI | 0.040 | 1130. |
| 7 | 370 | DILQKFQWIY | 0.020 | 1131. |
| 8 | 366 | KIPEDILQKF | 0.020 | 1132. |
| 9 | 377 | WIYPTQKLNK | 0.010 | 1133. |
| 10 | 371 | ILQKFQWIYP | 0.010 | 1134. |
| 11 | 376 | QWIYPTQKLN | 0.002 | 1135. |
| 12 | 373 | QKFQWIYPTQ | 0.001 | 1136. |
| 13 | 374 | KFQWIYPTQK | 0.001 | 1137. |
| 14 | 365 | TKIPEDILQK | 0.001 | 1138. |
| 15 | 368 | PEDILQKFQW | 0.000 | 1139. |

TABLE XVII (D)

Variant 4 and 5 {Splice variants 2
and 3 encode up to amino acid 373 then adds 15 new amino acids
(underlined)} KIPEDIL<u>QKFQWIYPTQKLNKMR</u>
(SEQ ID NO: 1286)
(amino acids 366-373 to 374*-388*) HLA
PEPTIDE SCORING RESULTS - 193P1E1B - B35, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 379 | YPTQKLNKM | 40.000 | 1140. |
| 2 | 367 | IPEDILQKF | 12.000 | 1141. |
| 3 | 371 | ILQKFQWIY | 2.000 | 1142. |
| 4 | 370 | DILQKFQWI | 0.400 | 1143. |
| 5 | 376 | QWIYPTQKL | 0.100 | 1144. |
| 6 | 377 | WIYPTQKLN | 0.100 | 1145. |
| 7 | 366 | KIPEDILQK | 0.060 | 1146. |
| 8 | 369 | EDILQKFQW | 0.050 | 1147. |
| 9 | 372 | LQKFQWIYP | 0.030 | 1148. |
| 10 | 375 | FQWIYPTQK | 0.010 | 1149. |
| 11 | 373 | QKFQWIYPT | 0.010 | 1150. |
| 12 | 374 | KFQWIYPTQ | 0.002 | 1151. |
| 13 | 378 | IYPTQKLNK | 0.001 | 1152. |
| 14 | 380 | PTQKLNKMR | 0.001 | 1153. |
| 15 | 368 | PEDILQKFQ | 0.000 | 1154. |

TABLE XVIII (D)

Variant 4 and 5 {Splice variants 2
and 3 encode up to amino acid 373 then adds 15 new amino acids
(underlined)} TKIPEDIL<u>QKFQWIYPTQKLNKMR</u>
(SEQ ID NO: 1287)
(amino acids 365-373 to 374*-388*)
HLA PEPTIDE SCORING
RESULTS - 193P1E1B - B35, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 366 | KIPEDILQKF | 4.000 | 1155. |
| 2 | 370 | DILQKFQWIY | 2.000 | 1156. |
| 3 | 375 | FQWIYPTQKL | 1.000 | 1157. |
| 4 | 372 | LQKFQWIYPT | 0.300 | 1158. |
| 5 | 379 | YPTQKLNKMR | 0.200 | 1159. |
| 6 | 378 | IYPTQKLNKM | 0.200 | 1160. |
| 7 | 367 | IPEDILQKFQ | 0.120 | 1161. |
| 8 | 369 | EDILQKFQWI | 0.040 | 1162. |
| 9 | 371 | ILQKFQWIYP | 0.010 | 1163. |
| 10 | 376 | QWIYPTQKLN | 0.010 | 1164. |
| 11 | 377 | WIYPTQKLNK | 0.010 | 1165. |
| 12 | 374 | KFQWIYPTQK | 0.002 | 1166. |
| 13 | 368 | PEDILQKFQW | 0.002 | 1167. |
| 14 | 365 | TKIPEDILQK | 0.002 | 1168. |
| 15 | 373 | QKFQWIYPTQ | 0.001 | 1169. |

TABLE V (E): Variant 6 - [RALDGEESLLSKYNSN] (SEQ ID NO: 1288)
(amino acids 27-34 and 374-381) -
HLA PEPTIDE SCORING RESULTS - 193P1E1B - A1, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 30 | DGEESLLSK | 22.500 | 1170. |
| 2 | 31 | GEESLLSKY | 2.250 | 1171. |
| 3 | 28 | ALDGEESLL | 0.500 | 1172. |
| 4 | 33 | ESLLSKYNS | 0.030 | 1173. |
| 5 | 34 | SLLSKYNSN | 0.010 | 1174. |
| 6 | 27 | RALDGEESL | 0.010 | 1175. |
| 7 | 29 | LDGEESLLS | 0.003 | 1176. |
| 8 | 32 | EESLLSKYN | 0.001 | 1177. |

TABLE VI (E): Variant 6 [QRALDGEESLLSKYNSNL] (SEQ ID NO: 1289)
(amino acids 26-34 and 374-382) - HLA PEPTIDE
SCORING RESULTS - 193P1E1B - A1, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 30 | DGEESLLSKY | 11.250 | 1178. |
| 2 | 28 | ALDGEESLLS | 2.500 | 1179. |
| 3 | 29 | LDGEESLLSK | 0.050 | 1180. |
| 4 | 31 | GEESLLSKYN | 0.045 | 1181. |
| 5 | 33 | ESLLSKYNSN | 0.015 | 1182. |
| 6 | 34 | SLLSKYNSNL | 0.010 | 1183. |
| 7 | 27 | RALDGEESLL | 0.010 | 1184. |
| 8 | 32 | EESLLSKYNS | 0.001 | 1185. |

TABLE VII (E): Variant 6 [RALDGEESLLSKYNSN] (SEQ ID NO: 1288)
(amino acids 27-34 and 374-381) - HLA PEPTIDE
SCORING RESULTS - 193P1E1B - A2, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 28 | ALDGEESLL | 8.545 | 1186. |
| 2 | 27 | RALDGEESL | 2.205 | 1187. |
| 3 | 34 | SLLSKYNSN | 0.414 | 1188. |
| 4 | 29 | LDGEESLLS | 0.001 | 1189. |
| 5 | 32 | EESLLSKYN | 0.001 | 1190. |
| 6 | 31 | GEESLLSKY | 0.000 | 1191. |
| 7 | 33 | ESLLSKYNS | 0.000 | 1192. |
| 8 | 30 | DGEESLLSK | 0.000 | 1193. |

TABLE VIII (E): Variant 6 [QRALDGEESLLSKYNSNL] (SEQ ID NO: 1289)
(amino acids 26-34 and 374-382) - HLA PEPTIDE
SCORING RESULTS - 193P1E1B - A2, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 34 | SLLSKYNSNL | 79.041 | 1194. |
| 2 | 27 | RALDGEESLL | 4.501 | 1195. |
| 3 | 28 | ALDGEESLLS | 0.030 | 1196. |
| 4 | 26 | QRALDGEESL | 0.001 | 1197. |
| 5 | 31 | GEESLLSKYN | 0.001 | 1198. |
| 6 | 29 | LDGEESLLSK | 0.000 | 1199. |
| 7 | 33 | ESLLSKYNSN | 0.000 | 1200. |
| 8 | 32 | EESLLSKYNS | 0.000 | 1201. |

TABLE IX (E): Variant 6 - [RALDGEESLLSKYNSN] (SEQ ID NO: 1288)
(amino acids 27-34 and 374-381) - HLA PEPTIDE
SCORING RESULTS - 193P1E1B - A3, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 28 | ALDGEESLL | 0.900 | 1202. |
| 2 | 31 | GEESLLSKY | 0.054 | 1203. |
| 3 | 34 | SLLSKYNSN | 0.030 | 1204. |
| 4 | 30 | DGEESLLSK | 0.027 | 1205. |
| 5 | 27 | RALDGEESL | 0.009 | 1206. |
| 6 | 33 | ESLLSKYNS | 0.000 | 1207. |
| 7 | 29 | LDGEESLLS | 0.000 | 1208. |
| 8 | 32 | EESLLSKYN | 0.000 | 1209. |

TABLE X (E): Variant 6 [QRALDGEESLLSKYNSNL] (SEQ ID NO: 1289)
(amino acids 26-34 and 374-382) - HLA PEPTIDE
SCORING RESULTS - 193P1E1B - A3, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 34 | SLLSKYNSNL | 2.700 | 1210. |
| 2 | 28 | ALDGEESLLS | 0.120 | 1211. |
| 3 | 29 | LDGEESLLSK | 0.090 | 1212. |
| 4 | 27 | RALDGEESLL | 0.009 | 1213. |
| 5 | 30 | DGEESLLSKY | 0.003 | 1214. |
| 6 | 26 | QRALDGEESL | 0.001 | 1215. |
| 7 | 32 | EESLLSKYNS | 0.000 | 1216. |
| 8 | 31 | GEESLLSKYN | 0.000 | 1217. |

TABLE XI (E): Variant 6 - [RALDGEES<u>LLSKYNSN</u>] (SEQ ID NO: 1288) (amino acids 27-34 and 374-381) - HLA PEPTIDE SCORING RESULTS - 193P1E1B - A11, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 30 | DGEESLLSK | 0.012 | 1218. |
| 2 | 27 | RALDGEESL | 0.009 | 1219. |
| 3 | 28 | ALDGEESLL | 0.004 | 1220. |
| 4 | 31 | GEESLLSKY | 0.002 | 1221. |
| 5 | 34 | SLLSKYNSN | 0.001 | 1222. |
| 6 | 29 | LDGEESLLS | 0.000 | 1223. |
| 7 | 33 | ESLLSKYNS | 0.000 | 1224. |
| 8 | 32 | EESLLSKYN | 0.000 | 1225. |

TABLE XII (E): Variant 6 [QRALDGEES<u>LLSKYNSNL</u>] (SEQ ID NO: 1289) (amino acids 26-34 and 374-382) - HLA PEPTIDE SCORING RESULTS - 193P1E1B - A11, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 29 | LDGEESLLSK | 0.040 | 1226. |
| 2 | 27 | RALDGEESLL | 0.009 | 1227. |
| 3 | 34 | SLLSKYNSNL | 0.006 | 1228. |
| 4 | 28 | ALDGEESLLS | 0.001 | 1229. |
| 5 | 26 | QRALDGEESL | 0.000 | 1230. |
| 6 | 31 | GEESLLSKYN | 0.000 | 1231. |
| 7 | 30 | DGEESLLSKY | 0.000 | 1232. |
| 8 | 32 | EESLLSKYNS | 0.000 | 1233. |

TABLE XIII (E): Variant 6 - [RALDGEES<u>LLSKYNSN</u>] (SEQ ID NO: 1288) (amino acids 27-34 and 374-381) - HLA PEPTIDE SCORING RESULTS - 193P1E1B - A24, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 27 | RALDGEESL | 14.400 | 1234. |
| 2 | 28 | ALDGEESLL | 4.000 | 1235. |
| 3 | 34 | SLLSKYNSN | 0.180 | 1236. |
| 4 | 33 | ESLLSKYNS | 0.150 | 1237. |
| 5 | 31 | GEESLLSKY | 0.020 | 1238. |
| 6 | 30 | DGEESLLSK | 0.018 | 1239. |
| 7 | 32 | EESLLSKYN | 0.012 | 1240. |
| 8 | 29 | LDGEESLLS | 0.012 | 1241. |

TABLE XIV (E): Variant 6 [QRALDGEES<u>LLSKYNSNL</u>] (SEQ ID NO: 1289) (amino acids 26-34 and 374-382) - HLA PEPTIDE SCORING RESULTS - 193P1E1B - A24, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 27 | RALDGEESLL | 14.400 | 1242. |
| 2 | 34 | SLLSKYNSNL | 6.000 | 1243. |
| 3 | 26 | QRALDGEESL | 0.400 | 1244. |
| 4 | 30 | DGEESLLSKY | 0.238 | 1245. |
| 5 | 33 | ESLLSKYNSN | 0.180 | 1246. |
| 6 | 28 | ALDGEESLLS | 0.100 | 1247. |
| 7 | 31 | GEESLLSKYN | 0.018 | 1248. |
| 8 | 32 | EESLLSKYNS | 0.010 | 1249. |

TABLE XV (E)

Variant 6 - [RALDGEES<u>LLSKYNSN</u>] (SEQ ID NO: 1288) (amino acids 27-34 and 374-381) - HLA PEPTIDE SCORING RESULTS - 193P1E1B - B7, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 27 | RALDGEESL | 12.000 | 1250. |
| 2 | 28 | ALDGEESLL | 3.600 | 1251. |
| 3 | 33 | ESLLSKYNS | 0.020 | 1252. |
| 4 | 34 | SLLSKYNSN | 0.020 | 1253. |
| 5 | 30 | DGEESLLSK | 0.003 | 1254. |
| 6 | 29 | LDGEESLLS | 0.002 | 1255. |
| 7 | 32 | EESLLSKYN | 0.002 | 1256. |
| 8 | 31 | GEESLLSKY | 0.001 | 1257. |

TABLE XVI (E)

Variant 6 [QRALDGEES<u>LLSKYNSNL</u>] (SEQ ID NO: 1289) (amino acids 26-34 and 374-382) - HLA PEPTIDE SCORING RESULTS - 193P1E1B - B7, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 27 | RALDGEESLL | 12.000 | 1258. |
| 2 | 34 | SLLSKYNSNL | 4.000 | 1259. |

TABLE XVI (E)-continued

Variant 6 [QRALDGEESLLSKYNSNL] (SEQ ID NO: 1289)
(amino acids 26-34 and 374-382) - HLA PEPTIDE SCORING RESULTS -
193P1E1B - B7, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 3 | 26 | QRALDGEESL | 0.400 | 1260. |
| 4 | 33 | ESLLSKYNSN | 0.020 | 1261. |
| 5 | 28 | ALDGEESLLS | 0.018 | 1262. |
| 6 | 30 | DGEESLLSKY | 0.006 | 1263. |
| 7 | 32 | EESLLSKYNS | 0.002 | 1264. |
| 8 | 29 | LDGEESLLSK | 0.001 | 1265. |

TABLE XVII (E)

Variant 6 - [RALDGEESLLSKYNSN] SEQ ID NO: 1288) (amino acids 27-34 and 374-381) -
HLA PEPTIDE SCORING RESULTS - 193P1E1B - B35, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 27 | 1 | RALDGEESL | 1266. |
| 2 | 33 | 7 | ESLLSKYNS | 1267. |
| 3 | 28 | 2 | ALDGEESLL | 1268. |
| 4 | 34 | 8 | SLLSKYNSN | 1269. |
| 5 | 31 | 5 | GEESLLSKY | 1270. |
| 6 | 29 | 3 | LDGEESLLS | 1271. |
| 7 | 32 | 6 | EESLLSKYN | 1272. |
| 8 | 30 | 4 | DGEESLLSK | 1273. |

TABLE XVIII (E)

Variant 6 [QRALDGEESLLSKYNSNL] (SEQ ID NO: 1289)
(amino acids 26-34 and 374-382) - HLA PEPTIDE SCORING RESULTS - 193P1E1B - B35,
10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID # |
|---|---|---|---|---|
| 1 | 27 | RALDGEESLL | 18.000 | 1274. |
| 2 | 30 | DGEESLLSKY | 1.200 | 1275. |
| 3 | 34 | SLLSKYNSNL | 1.000 | 1276. |
| 4 | 33 | ESLLSKYNSN | 0.500 | 1277. |
| 5 | 26 | QRALDGEESL | 0.100 | 1278. |
| 6 | 28 | ALDGEESLLS | 0.045 | 1279. |
| 7 | 32 | EESLLSKYNS | 0.010 | 1280. |
| 8 | 31 | GEESLLSKYN | 0.003 | 1281. |

TABLE XIX

Motifs and Post-translational Modifications of 193P1E1B

N-glycosylation sites
Number of matches: 3

1  246-249 NKSE (SEQ ID NO: 1290)
2  316-319 NSSS (SEQ ID NO: 1291)
3  340-343 NLTD (SEQ ID NO: 1292)

cAMP - and cGMP - dependent protein kinase phosphorylation site 107-110 KKNS (SEQ ID NO: 1293)

Protein kinase C phosphorylation sites
Number of matches: 10

1  22-24 TAR
2  53-55 TLK
3  103-105 SPR
4  152-154 SPR

TABLE XIX-continued

Motifs and Post-translational Modifications of 193P1E1B 5  149-151 SEK
6  103-105 SPR
7  152-154 SPR
8  203-205 TPK
9  217-219 TPK
10 203-205 TPK Casein kinase II phosphorylation sites
Number of matches: 12

1  16-19 STLD (SEQ ID NO: 1294)
2  34-37 SDFE (SEQ ID NO: 1295)
3  53-56 TLKD (SEQ ID NO: 1296)
4  110-113 SVHE (SEQ ID NO: 1297)
5  119-122 SDPE (SEQ ID NO: 1298)
6  124-127 SNCE (SEQ ID NO: 1299)
7  276-279 SDAE (SEQ ID NO: 1300)

TABLE XIX-continued

Motifs and Post-translational Modifications of 193P1E1B

```
  8 318-321 SSND (SEQ ID NO: 1301)
  9 336-339 TCFE (SEQ ID NO: 1302)
 10 350-353 SSYE (SEQ ID NO: 1303)
 11 360-363 TPPE (SEQ ID NO: 1304)
 12 408-411 SNKE (SEQ ID NO: 1305)
              N-myristoylation site 239-244 GLKNAR (SEQ ID NO: 1306)
```

TABLE XX

Frequently Occurring Motifs

| Name | avrg. % identity | Description | Potential Function |
|---|---|---|---|
| zf-C2H2 | 34% | Zinc finger, C2H2 type | Nucleic acid-binding protein functions as transcription factor, nuclear location probable |
| cytochrome_b_N | 68% | Cytochrome b(N-terminal)/b6/petB | membrane bound oxidase, generate superoxide |
| ig | 19% | Immunoglobulin domain | domains are one hundred amino acids long and include a conserved intradomain disulfide bond. |
| WD40 | 18% | WD domain, G-beta repeat | tandem repeats of about 40 residues, each containing a Trp-Asp motif. Function in signal transduction and protein interaction |
| PDZ | 23% | PDZ domain | may function in targeting signaling molecules to sub-membranous sites |
| LRR | 28% | Leucine Rich Repeat | short sequence motifs involved in protein-protein interactions |
| pkinase | 23% | Protein kinase domain | conserved catalytic core common to both serine/threonine and tyrosine protein kinases containing an ATP binding site and a catalytic site |
| PH | 16% | PH domain | pleckstrin homology involved in intracellular signaling or as constituents of the cytoskeleton |
| EGF | 34% | EGF-like domain | 30-40 amino-acid long found in the extracellular domain of membrane-bound proteins or in secreted proteins |
| rvt | 49% | Reverse transcriptase (RNA-dependent DNA polymerase) | |
| ank | 25% | Ank repeat | Cytoplasmic protein, associates integral membrane proteins to the cytoskeleton |
| oxidored q1 | 32% | NADH-Ubiquinone/plastoquinone | membrane associated. Involved in proton translocation across the membrane |
| efhand | 24% | EF hand | calcium-binding domain, consists of a 12 residue loop flanked on both sides by a 12 residue alpha-helical domain |
| rvp | 79% | Retroviral aspartyl protease | Aspartyl or acid proteases, centered on a catalytic aspartyl residue |
| Collagen | 42% | Collagen triple helix repeat (20 copies) | extracellular structural proteins involved in formation of connective tissue. The sequence consists of the G-X-Y and the polypeptide chains forms a triple helix. |
| fn3 | 20% | Fibronectin type III domain | Located in the extracellular ligand-binding region of receptors and is about 200 amino acid residues long with two pairs of cysteines involved in disulfide bonds |
| 7tm 1 | 19% | 7 transmembrane receptor (rhodopsin family) | seven hydrophobic transmembrane regions, with the N-terminus located extracellularly while the C-terminus is cytoplasmic. Signal through G proteins |

(complex I), various chains

TABLE XXI

Properties of 193P1E1B
Motifs and localization apply to 193P1E1B variants 1-5.

| | Bioinformatic Program | Outcome |
|---|---|---|
| ORF | ORF Finder | (includes stop) |
| Protein Length | n/a | 73-412 amino acids |
| Transmembrane region | TM Pred | No TM |
| | HMMTop | No TM |
| | Sosui | No TM, soluble |
| | TMHMM | No TM |
| Signal Peptide | Signal P | indicates no signal |
| pI | pI/MW tool | pI 5.03-5.18 |
| Molecular weight | pI/MW tool | 46.2-36.9 kDa |
| Localization | PSORT | Mitochondrial 48% |
| | PSORT II | Nuclear 60% |
| | iPSORT | No signal motif |
| Motifs | Pfam | No motif |
| | Prints | Rhodopsin |
| | Blocks | No motif |
| | Prosite | No motif |

TABLE XXIIA

Nucleotide sequence of 193P1E1B v.3. (SEQ ID NO:1307)

```
  1 tatcatctgt gactgaggaa atccctatct tcctatcaga ctaatgaaac cacaggacag
 61 caattagact tttaagtatt gggggggttta gagctctaga tattcgatat gcagactact
121 catgtttgtt tgttttaata aagactggtc caaaggctca ttttcacaca agctacagtt
181 tttcagttcc aggaccaggt aaagatggtc agctccgtga tccataaaat ccaagggtga
241 cgactcagga ttaggaccat ttcttggtga cattgagatg gtcgagctgg tccgcaatga
```

TABLE XXIIA-continued

Nucleotide sequence of 193P1E1B v.3. (SEQ ID NO:1307)

```
 301 atctatgcgg ggggaacttg gaagtggcgg ccgcctttat ggcctcgaag gcctccctcc
 361 tgcgcaccgc ggcgtggccg cgctcctgct cccgggtcat gtagggcatg ctcagccagt
 421 aatggttctc cgcctcgatc tccaggcggc ggatcatgtt ctgcttggcg cgcaacgaca
 481 cgaaccgcgg ccgccggtgc ttcccgatcc actgacggcc gggaatgcgg ccgcgccaga
 541 ggagcgcagt caggaacatg gtgcctgccg cgctgctcaa gactctgcgt ctccgcggcc
 601 gccagcagac gccgtggcgt aagcgcaccc gtctcgcggg gtctccgggg gcctcggcga
 661 gagacttcgg ctctcgcgag agaggactgc gcctgcgcag agccgaggac gcgtccggcg
 721 ccgagattca aactagtggc gggaggctgt gagctgagcg gtggggtctg cgtacgcctg
 781 gagtccttcc ccgctgtgct cagcatggac cctatccgga gcttctgcgg gaagctgcgg
 841 tctctggcca gcacgctgga ctgcgagacg gcccggctgc agcgagcgct ggacggagag
 901 gaaagcggat gatgttaata ttcttcttga taaagcaaga ttggaaaatc aagaaggcat
 961 tgatttcata aaggcaacaa aagtactaat ggaaaaaaat tcaatggata ttatgaaaat
1021 aagagagtat ttccagaagt atggatatag tccacgtgtc aagaaaaatt cagtacacga
1081 gcaagaagcc attaactctg acccagagtt gtctaattgt gaaaattttc agaagactga
1141 tgtgaaagat gatctgtctg atcctcctgt tgcaagcagt tgtatttctg agaagtctcc
1201 acgtagtcca caactttcag attttggact tgagcggtac atcgtatccc aagttctacc
1261 aaaccctcca caggcagtga acaactataa ggaagagccc gtaattgtaa ccccacctac
1321 caaacaatca ctagtaaaag tactaaaaac tccaaaatgt gcactaaaaa tggatgattt
1381 tgagtgtgta actcctaaat tagaacactt tggtatctct gaatatacta tgtgtttaaa
1441 tgaagattac acaatgggac ttaaaaatgc gaggaataat aaaagtgagg aggccataga
1501 tgcagaatcc aggctcaatg ataatgtttt tgccactccc agccccatca tccagcagtt
1561 ggaaaaaagt gatgccgaat ataccaactc tcctttggta cctacattct gtactcctgg
1621 tttgaaaatt ccatctacaa agaacagcat agctttggta tccacaaatt accattatc
1681 aaaaacaaat agttcatcaa atgatttgga agttgaagat cgtacttcgt tggttttaaa
1741 ttcagacaca tgctttgaga atttaacaga tccctcttca cctacgattt cttcttatga
1801 gaatctgctc agaacaccta cacctccaga agtaactaaa attccagaag atattctcca
1861 gcttttatca aaatacaact caaacctagc tactccaata gcaattaaag cagtgccacc
1921 cagtaaaagg ttccttaaac atggacagaa catccgagat gtcagcaaca aagaaaactg
1981 aaattccagt ggatctatcc aacacagaaa ctgaacaaaa tgagatgaaa gccgagctgg
2041 accgatttta acattcacat tgccctgcct ctgtccccct ttaaacgttg acccatttta
2101 aagacaaaca tgaacattaa catcataata tgcttttat gaagtttcaa taaggtttaa
2161 ccttagtctt gttgacatgt agcccagtca ttcactcttt aaggactatt agtgtttcat
2221 tgatactaaa ttacccagct taatcaacag aatggtttaa gtagtaccag gaagtaggac
2281 aagtaatttc aaaaatataa aggtgtttgc tactcagatg aggccgcccc tgaccttctg
2341 gccagagaga cattgctgcc agccagctct gccttcccat catctccttt caggaccgtc
2401 ccacacctt tacttgctca gtgctgtctg aagatgcagt tgctgtttgc aaacaacagg
2461 aacaccagtt aaactaatta ggaaacagag ggagatttcc aggcctgggt aactatatac
2521 tgtgaccatt ggcggttgag accggtcttc aaccagtgga accccgaact ctgctgtcag
```

TABLE XXIIA-continued

Nucleotide sequence of 193P1E1B v.3. (SEQ ID NO:1307)

```
2581 ggtgtggact tcggtgctct tccaagtttt cacctggggg ggggagctaa ccccctatgt 2641 tcacgccttc tattcccatt ggcgctgaac tcttaaggtc actctggtcg cttgtgaccc 2701 cgtaaccctg atgtacccct ctaaaaggtg aggggc
```

TABLE XXIIIA

Nucleotide sequence alignment of 193P1E1B v.1 with 193P1E1B v.3.

```
Score = 1744 bits (907), Expect = 0.0 Identities = 907/907 (100%) Strand =
Plus/Plus (portion of SEQ ID NO: 1308)
193P1E1Bv.1:     1 tatcatctgtgactgaggaaatccctatcttcctatcagactaatgaaaccacaggacag   60
                   ||||||||||||||||||||||||||||||||||||||||||||||||||||||||||||
193P1E1Bv.3:     1 tatcatctgtgactgaggaaatccctatcttcctatcagactaatgaaaccacaggacag   60

(SEQ ID NO: 1307)

193P1E1Bv.1:    61 caattagacttttaagtattggggggtttagagctctagatattcgatatgcagactact  120
                   ||||||||||||||||||||||||||||||||||||||||||||||||||||||||||||
193P1E1Bv.3:    61 caattagacttttaagtattggggggtttagagctctagatattcgatatgcagactact  120

193P1E1Bv.1:   121 catgtttgtttgttttaataaagactggtccaaaggctcattttcacacaagctacagtt  180
                   ||||||||||||||||||||||||||||||||||||||||||||||||||||||||||||
193P1E1Bv.3:   121 catgtttgtttgttttaataaagactggtccaaaggctcattttcacacaagctacagtt  180

193P1E1Bv.1:   181 tttcagttccaggaccaggtaaagatggtcagctccgtgatccataaaatccaagggtga  240
                   ||||||||||||||||||||||||||||||||||||||||||||||||||||||||||||
193P1E1Bv.3:   181 tttcagttccaggaccaggtaaagatggtcagctccgtgatccataaaatccaagggtga  240

193P1E1Bv.1:   241 cgactcaggattaggaccatttcttggtgacattgagatggtcgagctggtccgcaatga  300
                   ||||||||||||||||||||||||||||||||||||||||||||||||||||||||||||
193P1E1Bv.3:   241 cgactcaggattaggaccatttcttggtgacattgagatggtcgagctggtccgcaatga  300

193P1E1Bv.1:   301 atctatgcggggggaacttggaagtggcggccgcctttatggcctcgaaggcctccctcc  360
                   ||||||||||||||||||||||||||||||||||||||||||||||||||||||||||||
193P1E1Bv.3:   301 atctatgcggggggaacttggaagtggcggccgcctttatggcctcgaaggcctccctcc  360

193P1E1Bv.1:   361 tgcgcaccgcggcgtggccgcgctcctgctcccgggtcatgtagggcatgctcagccagt  420
                   ||||||||||||||||||||||||||||||||||||||||||||||||||||||||||||
193P1E1Bv.3:   361 tgcgcaccgcggcgtggccgcgctcctgctcccgggtcatgtagggcatgctcagccagt  420

193P1E1Bv.1:   421 aatggttctccgcctcgatctccaggcggcggatcatgttctgcttggcgcgcaacgaca  480
                   ||||||||||||||||||||||||||||||||||||||||||||||||||||||||||||
193P1E1Bv.3:   421 aatggttctccgcctcgatctccaggcggcggatcatgttctgcttggcgcgcaacgaca  480

193P1E1Bv.1:   481 cgaaccgcggccgccggtgcttcccgatccactgacggcccgggaatgcggccgcgccaga  540
                   ||||||||||||||||||||||||||||||||||||||||||||||||||||||||||||
193P1E1Bv.3:   481 cgaaccgcggccgccggtgcttcccgatccactgacggcccgggaatgcggccgcgccaga  540

193P1E1Bv.1:   541 ggagcgcagtcaggaacatggtgcctgccgcgctgctcaagactctgcgtctccgcggcc  600
                   ||||||||||||||||||||||||||||||||||||||||||||||||||||||||||||
193P1E1Bv.4:   541 ggagcgcagtcaggaacatggtgcctgccgcgctgctcaagactctgcgtctccgcggcc  600

193P1E1Bv.1:   601 gccagcagacgccgtggcgtaagcgcacccgtctcgcggggtctccgggggcctcggcga  660
                   ||||||||||||||||||||||||||||||||||||||||||||||||||||||||||||
193P1E1Bv.3:   601 gccagcagacgccgtggcgtaagcgcacccgtctcgcggggtctccgggggcctcggcga  660

193P1E1Bv.1:   661 gagacttcggctctcgcgagagaggactgcgcctgcgcagagccgaggacgcgtccggcg  720
                   ||||||||||||||||||||||||||||||||||||||||||||||||||||||||||||
193P1E1Bv.3:   661 gagacttcggctctcgcgagagaggactgcgcctgcgcagagccgaggacgcgtccggcg  720

193P1E1Bv.1:   721 ccgagattcaaactagtggcgggaggctgtgagctgagcggtggggtctgcgtacgcctg  780
                   ||||||||||||||||||||||||||||||||||||||||||||||||||||||||||||
193P1E1Bv.3:   721 ccgagattcaaactagtggcgggaggctgtgagctgagcggtggggtctgcgtacgcctg  780

193P1E1Bv.1:   781 gagtccttccccgctgtgctcagcatggaccctatccggagcttctgcgggaagctgcgg  840
                   ||||||||||||||||||||||||||||||||||||||||||||||||||||||||||||
193P1E1Bv.3:   781 gagtccttccccgctgtgctcagcatggaccctatccggagcttctgcgggaagctgcgg  840

193P1E1Bv.1:   841 tctctggccagcacgctggactgcgagacggcccggctgcagcgagcgctggacggagag  900
                   ||||||||||||||||||||||||||||||||||||||||||||||||||||||||||||
193P1E1Bv.3:   841 tctctggccagcacgctggactgcgagacggcccggctgcagcgagcgctggacggagag  900
```

TABLE XXIIIA-continued

Nucleotide sequence alignment of 193P1E1B v.1 with 193P1E1B v.3.

```
193P1E1Bv.1:  901 gaaagcg                                                     907
                  |||||||
193P1E1Bv.3:  901 gaaagcg                                                     907
```

Score = 3513 bits (1827), Expect = 0.0 Identities = 1829/1830 (99%) Strand = Plus/Plus (portion of SEQ ID NO: 1308)

```
193P1E1Bv.1:  969 ggatgatgttaatattcttcttgataaagcaagattggaaaatcaagaaggcattgattt 1028
                  ||||||||||||||||||||||||||||||||||||||||||||||||||||||||||||
193P1E1Bv.3:  907 ggatgatgttaatattcttcttgataaagcaagattggaaaatcaagaaggcattgattt  966
```

SEQ ID NO: 1307 cont.)

```
193P1E1Bv.1: 1029 cataaaggcaacaaaagtactaatggaaaaaaattcaatggatattatgaaaataagaga 1088
                  ||||||||||||||||||||||||||||||||||||||||||||||||||||||||||||
193P1E1Bv.3:  967 cataaaggcaacaaaagtactaatggaaaaaaattcaatggatattatgaaaataagaga 1026

193P1E1Bv.1: 1089 gtatttccagaagtatggatatagtccacgtgtcaagaaaaattcagtacacgagcaaga 1148
                  ||||||||||||||||||||||||||||||||||||||||||||||||||||||||||||
193P1E1Bv.3: 1027 gtatttccagaagtatggatatagtccacgtgtcaagaaaaattcagtacacgagcaaga 1086

193P1E1Bv.1: 1149 agccattaactctgacccagagttgtctaattgtgaaaattttcagaagactgatgtgaa 1208
                  ||||||||||||||||||||||||||||||||||||||||||||||||||||||||||||
193P1E1Bv.3: 1087 agccattaactctgacccagagttgtctaattgtgaaaattttcagaagactgatgtgaa 1146

193P1E1Bv.1: 1209 agatgatctgtctgatcctcctgttgcaagcagttgtatttctgagaagtctccacgtag 1268
                  ||||||||||||||||||||||||||||||||||||||||||||||||||||||||||||
193P1E1Bv.3: 1147 agatgatctgtctgatcctcctgttgcaagcagttgtatttctgagaagtctccacgtag 1206

193P1E1Bv.1: 1269 tccacaactttcagattttggacttgagcggtacatcgtatcccaagttctaccaaaccc 1328
                  ||||||||||||||||||||||||||||||||||||||||||||||||||||||||||||
193P1E1Bv.3: 1207 tccacaactttcagattttggacttgagcggtacatcgtatcccaagttctaccaaaccc 1266

193P1E1Bv.1: 1329 tccacaggcagtgaacaactataaggaagagcccgtaattgtaaccccacctaccaaaca 1388
                  ||||||||||||||||||||||||||||||||||||||||||||||||||||||||||||
193P1E1Bv.3: 1267 tccacaggcagtgaacaactataaggaagagcccgtaattgtaaccccacctaccaaaca 1326

193P1E1Bv.1: 1389 atcactagtaaaagtactaaaaactccaaaatgtgcactaaaaatggatgattttgagtg 1448
                  ||||||||||||||||||||||||||||||||||||||||||||||||||||||||||||
193P1E1Bv.3: 1327 atcactagtaaaagtactaaaaactccaaaatgtgcactaaaaatggatgattttgagtg 1386

193P1E1Bv.1: 1449 tgtaactcctaaattagaacactttggtatctctgaatatactatgtgtttaaatgaaga 1508
                  ||||||||||||||||||||||||||||||||||||||||||||||||||||||||||||
193P1E1Bv.3: 1327 tgtaactcctaaattagaacactttggtatctctgaatatactatgtgtttaaatgaaga 1446

193P1E1Bv.1: 1509 ttacacaatgggacttaaaaatgcgaggaataataaaagtgaggaggccatagatacaga 1568
                  ||||||||||||||||||||||||||||||||||||||||||||||||||||||||||||
193P1E1Bv.3: 1447 ttacacaatgggacttaaaaatgcgaggaataataaaagtgaggaggccatagatacaga 1506

193P1E1Bv.1: 1569 atccaggctcaatgataatgttttgccactcccagccccatcatccagcagttggaaaa 1628
                  ||||||||||||||||||||||||||||||||||||||||||||||||||||||||||||
193P1E1Bv.3: 1507 atccaggctcaatgataatgttttgccactcccagccccatcatccagcagttggaaaa 1566

193P1E1Bv.1: 1629 aagtgatgccgaatataccaactctcctttggtacctacattctgtactcctggtttgaa 1688
                  ||||||||||||||||||||||||||||||||||||||||||||||||||||||||||||
193P1E1Bv.3: 1567 aagtgatgccgaatataccaactctcctttggtacctacattctgtactcctggtttgaa 1626

193P1E1Bv.1: 1689 aattccatctacaaagaacagcatagctttggtatccacaaattacccattatcaaaaac 1748
                  ||||||||||||||||||||||||||||||||||||||||||||||||||||||||||||
193P1E1Bv.3: 1627 aattccatctacaaagaacagcatagctttggtatccacaaattacccattatcaaaaac 1686

193P1E1Bv.1: 1749 aaatagttcatcaaatgatttggaagttgaagatcgtacttcgttggttttaaattcaga 1808
                  ||||||||||||||||||||||||||||||||||||||||||||||||||||||||||||
193P1E1Bv.3: 1687 aaatagttcatcaaatgatttggaagttgaagatcgtacttcgttggttttaaattcaga 1746

193P1E1Bv.1: 1809 cacatgctttgagaatttaacagatccctcttcacctacgatttcttcttatgagaatct 1868
                  ||||||||||||||||||||||||||||||||||||||||||||||||||||||||||||
193P1E1Bv.3: 1747 cacatgctttgagaatttaacagatccctcttcacctacgatttcttcttatgagaatct 1806

193P1E1Bv.1: 1869 gctcagaacacctacacctccagaagtaactaaaattccagaagatattctccagctttt 1928
                  ||||||||||||||||||||||||||||||||||||||||||||||||||||||||||||
193P1E1Bv.3: 1807 gctcagaacacctacacctccagaagtaactaaaattccagaagatattctccagctttt 1866

193P1E1Bv.1: 1929 atcaaaatacaactcaaacctagctactccaatagcaattaaagcagtgccacccagtaa 1988
                  ||||||||||||||||||||||||||||||||||||||||||||||||||||||||||||
193P1E1Bv.3: 1867 atcaaaatacaactcaaacctagctactccaatagcaattaaagcagtgccacccagtaa 1926
```

TABLE XXIIIA-continued

Nucleotide sequence alignment of 193P1E1B v.1 with 193P1E1B v.3.

```
193P1E1Bv.1: 1989 aaggttccttaaacatggacagaacatccgagatgtcagcaacaaagaaaactgaaattc 2048
                  ||||||||||||||||||||||||||||||||||||||||||||||||||||||||||||
193P1E1Bv.3: 1927 aaggttccttaaacatggacagaacatccgagatgtcagcaacaaagaaaactgaaattc 1986

193P1E1Bv.1: 2049 cagtggatctatccaacacagaaactgaacaaaatgagatgaaagccgagctggaccgat 2108
                  ||||||||||||||||||||||||||||||||||||||||||||||||||||||||||||
193P1E1Bv.3: 1987 cagtggatctatccaacacagaaactgaacaaaatgagatgaaagccgagctggaccgat 2046

193P1E1Bv.1: 2109 tttaacattcacattgccctgcctctgtccccctttaaacgttgacccattttaaagaca 2168
                  ||||||||||||||||||||||||||||||||||||||||||||||||||||||||||||
193P1E1Bv.3: 2047 tttaacattcacattgccctgcctctgtccccctttaaacgttgacccattttaaagaca 2106

193P1E1Bv.1: 2169 aacatgaacattaacatcataatatgcttttatgaagtttcaataaggtttaaccttag 2228
                  ||||||||||||||||||||||||||||||||||||||||||||||||||||||||||||
193P1E1Bv.3: 2107 aacatgaacattaacatcataatatgcttttatgaagtttcaataaggtttaaccttag 2166

193P1E1Bv.1: 2229 tcttgttgacatgtagcccagtcattcactctttaaggactattagtgtttcattgatac 2288
                  ||||||||||||||||||||||||||||||||||||||||||||||||||||||||||||
193P1E1Bv.3: 2167 tcttgttgacatgtagcccagtcattcactctttaaggactattagtgtttcattgatac 2226

193P1E1Bv.1: 2289 taaattacccagcttaatcaacagaatggtttaagtagtaccaggaagtaggacaagtaa 2348
                  ||||||||||||||||||||||||||||||||||||||||||||||||||||||||||||
193P1E1Bv.3: 2227 taaattacccagcttaatcaacagaatggtttaagtagtaccaggaagtaggacaagtaa 2286

193P1E1Bv.1: 2349 tttcaaaaatataaaggtgtttgctactcagatgaggccgcccctgaccttctggccaga 2408
                  ||||||||||||||||||||||||||||||||||||||||||||||||||||||||||||
193P1E1Bv.3: 2287 tttcaaaaatataaaggtgtttgctactcagatgaggccgcccctgaccttctggccaga 2346

193P1E1Bv.1: 2409 gagacattgctgccagccagctctgccttcccatcatctcctttcaggaccgtcccacac 2468
                  ||||||||||||||||||||||||||||||||||||||||||||||||||||||||||||
193P1E1Bv.3: 2347 gagacattgctgccagccagctctgccttcccatcatctcctttcaggaccgtcccacac 2406

193P1E1Bv.1: 2469 cttttacttgctcagtgctgtctgaagatgcagttgctgtttgcaaacaacaggaacacc 2528
                  ||||||||||||||||||||||||||||||||||||||||||||||||||||||||||||
193p1E1Bv.3: 2407 cttttacttgctcagtgctgtctgaagatgcagttgctgtttgcaaacaacaggaacacc 2466

193P1E1Bv.1: 2529 agttaaactaattaggaaacagagggagatttccaggcctgggtaactatatactgtgac 2588
                  ||||||||||||||||||||||||||||||||||||||||||||||||||||||||||||
193P1E1Bv.3: 2467 agttaaactaattaggaaacagagggagatttccaggcctgggtaactatatactgtgac 2526

193P1E1Bv.1: 2589 cattggcggttgagaccggtcttcaaccagtggaaccccgaactctgctgtcagggtgtg 2648
                  ||||||||||||||||||||||||||||||||||||||||||||||||||||||||||||
193P1E1Bv.3: 2527 cattggcggttgagaccggtcttcaaccagtggaaccccgaactctgctgtcagggtgtg 2586

193P1E1Bv.1: 2649 gacttcggtgctcttccaagttttcacctggggggggagctaaccccctatgttcacgc 2708
                  ||||||||||||||||||||||||||||||||||||||||||||||||||||||||||||
193P1E1Bv.3: 2587 gacttcggtgctcttccaagttttcacctggggggggagctaaccccctatgttcacgc 2646

193P1E1Bv.1: 2709 cttctattcccattggcgctgaactcttaaggtcactctggtcgcttgtgaccccgtaac 2768
                  ||||||||||||||||||||||||||||||||||||||||||||||||||||||||||||
193P1E1Bv.3: 2647 cttctattcccattggcgctgaactcttaaggtcactctggtcgcttgtgaccccgtaac 2706

193P1E1Bv.1: 2769 cctgatgtacccctctaaaaggtgaggggc                              2798
                  ||||||||||||||||||||||||||||||
193P1E1Bv.3: 2707 cctgatgtacccctctaaaaggtgaggggc                              2736
```

TABLE XXIVA

Amino acid sequence alignment of 193P1E1B v.1 and 193P1E1B v.3. Score = 663 bits (1710),
Expect = 0.0 Identities = 329/330 (99%), Positives = 329/330 (99%)

```
193P1E1Bv.1:  83 MEKNSMDIMKIREYFQKYGYSPRVKKNSVHEQEAINSDPELSNCENFQKTDVKDDLSDPP 142 (SEQ ID NO:1309)
                 MEKNSMDIMKIREYFQKYGYSPRVKKNSVHEQEAINSDPELSNCENFQKTDVKDDLSDPP
193P1E1Bv.3:   1 MEKNSMDIMKIREYFQKYGYSPRVKKNSVHEQEAINSDPELSNCENFQKTDVKDDLSDPP  60

193P1E1Bv.1: 143 VASSCISEKSPRSPQLSDFGLERYIVSQVLPNPPQAVNNYKEEPVIVTPPTKQSLVKVLK 202 (SEQ ID NO:1310)
                 VASSCISEKSPRSPQLSDFGLERYIVSQVLPNPPQAVNNYKEEPVIVTPPTKQSLVKVLK
193P1E1Bv.3:  61 VASSCISEKSPRSPQLSDFGLERYIVSQVLPNPPQAVNNYKEEPVIVTPPTKQSLVKVLK 120

193P1E1Bv.1: 203 TPKCALKMDDFECVTPKLEHFGISEYTMCLNEDYTMGLKNARNNKSEEAIDTESRLNDNV 262
                 TPKCALKMDDFECVTPKLEHFGISEYTMCLNEDYTMGLKNARNNKSEEAID ESRLNDNV
193P1E1Bv.3: 121 TPKCALKMDDFECVTPKLEHFGISEYTMCLNEDYTMGLKNARNNKSEEAIDAESRLNDNV 180
```

TABLE XXIVA-continued

Amino acid sequence alignment of 193P1E1B v.1 and 193P1E1B v.3. Score = 663 bits (1710), Expect = 0.0 Identities = 329/330 (99%), Positives = 329/330 (99%)

```
193P1E1Bv.1:   263 FATPSPIIQQLEKSDAEYTNSPLVPTFCTPGLKIPSTKNSIALVSTNYPLSKTNSSSNDL 322
                   FATPSPIIQQLEKSDAEYTNSPLVPTFCTPGLKIPSTKNSIALVSTNYPLSKTNSSSNDL
193P1E1Bv.3:   181 FATPSPIIQQLEKSDAEYTNSPLVPTFCTPGLKIPSTKNSIALVSTNYPLSKTNSSSNDL 240

193P1E1Bv.1:   323 EVEDRTSLVLNSDTCFENLTDPSSPTISSYENLLRTPTPPEVTKIPEDILQLLSKYNSNL 382
                   EVEDRTSLVLNSDTCFENLTDPSSPTISSYENLLRTPTPPEVTKIPEDILQLLSKYNSNL
193P1E1Bv.3:   241 EVEDRTSLVLNSDTCFENLTDPSSPTISSYENLLRTPTPPEVTKIPEDILQLLSKYNSNL 300

193P1E1Bv.1:   383 ATPIAIKAVPPSKRFLKHGQNIRDVSNKEN                                412
                   ATPIAIKAVPPSKRFLKHGQNIRDVSNKEN
193P1E1Bv.3:   301 ATPIAIKAVPPSKRFLKHGQNIRDVSNKEN                                330
```

TABLE XXVA

Peptide sequence from the translation of the nucleotide sequence of 193P1E1B v.3. (SEQ ID NO: 1310)

```
MEKNSMDIMK IREYFQKYGY SPRVKKNSVH EQEAINSDPE LSNCENFQKT DVKDDLSDPP   60
VASSCISEKS PRSPQLSDFG LERYIVSQVL PNPPQAVNNY KEEPVIVTPP TKQSLVKVLK  120
TPKCALKMDD FECVTPKLEH FGISEYTMCL NEDYTMGLKN ARNNKSEEAI DAESRLNDNV  180
FATPSPIIQQ LEKSDAEYTN SPLVPTFCTP GLKIPSTKNS IALVSTNYPL SKTNSSSNDL  240
EVEDRTSLVL NSDTCFENLT DPSSPTISSY ENLLRTPTPP EVTKIPEDIL QLLSKYNSNL  300
ATPIAIKAVP PSKRFLKHGQ NIRDVSNKEN                                   330
*
```

TABLE XXIIB

Nucleotide sequence of 193P1E1B v.4. (SEQ ID NO:1311)

```
   1 tatcatctgt gactgaggaa atccctatct tcctatcaga ctaatgaaac cacaggacag
  61 caattagact tttaagtatt gggggtttta gagctctaga tattcgatat gcagactact
 121 catgtttgtt tgttttaata aagactggtc caaaggctca ttttcacaca agctacagtt
 181 tttcagttcc aggaccaggt aaagatggtc agctccgtga tccataaaat ccaagggtga
 241 cgactcagga ttaggaccat ttcttggtga cattgagatg gtcgagctgg tccgcaatga
 301 atctatgcgg ggggaacttg aagtggcgg ccgcctttat ggcctcgaag gcctccctcc
 361 tgcgcaccgc ggcgtggccg cgctcctgct cccgggtcat gtagggcatg ctcagccagt
 421 aatggttctc cgcctcgatc tccaggcggc ggatcatgtt ctgcttggcg cgcaacgaca
 481 cgaaccgcgg ccgccggtgc ttcccgatcc actgacggcc gggaatgcgg ccgcgccaga
 541 ggagcgcagt caggaacatg gtgcctgccg cgctgctcaa gactctgcgt ctccgcggcc
 601 gccagcagac gccgtggcgt aagcgcaccc gtctcgcggg gtctccgggg gcctcggcga
 661 gagacttcgg ctctcgcgag agaggactgc gcctgcgcag agccgaggac gcgtccggcg
 721 ccgagattca aactagtggc gggaggctgt gagctgagcg gtggggtctg cgtacgcctg
 781 gagtccttcc ccgctgtgct cagcatggac cctatccgga gcttctgcgg gaagctgcgg
 841 tctctggcca gcacgctgga ctgcgagacg gcccggctgc agcgagcgct ggacggagag
 901 gaaagcgact tgaagatta ccaatgaga atttatatg accttcattc agaagttcag
 961 actctaaagg atgatgttaa tattcttctt gataaagcaa gattggaaaa tcaagaaggc
1021 attgatttca taaaggcaac aaaagtacta atggaaaaaa attcaatgga tattatgaaa
```

TABLE XXIIB-continued

Nucleotide sequence of 193P1E1B v.4. (SEQ ID NO:1311)

```
1081 ataagagagt atttccagaa gtatggatat agtccacgtg tcaagaaaaa ttcagtacac
1141 gagcaagaag ccattaactc tgacccagag ttgtctaatt gtgaaaattt tcagaagact
1201 gatgtgaaag atgatctgtc tgatcctcct gttgcaagca gttgtatttc tgagaagtct
1261 ccacgtagtc cacaactttc agattttgga cttgagcggt acatcgtatc ccaagttcta
1321 ccaaaccctc cacaggcagt gaacaactat aaggaagagc ccgtaattgt aaccccacct
1381 accaaacaat cactagtaaa agtactaaaa actccaaaat gtgcactaaa aatggatgat
1441 tttgagtgtg taactcctaa attagaacac tttggtatct ctgaatatac tatgtgttta
1501 aatgaagatt acacaatggg acttaaaaat gcgaggaata ataaaagtga ggaggccata
1561 gatacagaat ccaggctcaa tgataatgtt tttgccactc ccagccccat catccagcag
1621 ttggaaaaaa gtgatgccga atataccaac tctcctttgg tacctacatt ctgtactcct
1681 ggtttgaaaa ttccatctac aaagaacagc atagctttgg tatccacaaa ttcccatta
1741 tcaaaaacaa atagttcatc aaatgatttg gaagttgaag atcgtacttc gttggtttta
1801 aattcagaca catgctttga gaatttaaca gatccctctt cacctacgat ttcttcttat
1861 gagaatctgc tcagaacacc tacacctcca gaagtaacta aaattccaga agatattctc
1921 cagaaattcc agtggatcta tccaacacag aaactgaaca aaatgagatg aaagccgagc
1981 tggaccgatt ttaacattca cattgccctg cctctgtccc cctttaaacg ttgacccatt
2041 ttaaagacaa acatgaacat taacatcata atatgctttt tatgaagttt caataaggtt
2101 taaccttagt cttgttgaca tgtagcccag tcattcactc tttaaggact attagtgttt
2161 cattgatact aaattaccca gcttaatcaa cagaatggtt taagtagtac caggaagtag
2221 gacaagtaat ttcaaaaata taaaggtgtt tgctactcag atgaggccgc ccctgaccct
2281 ctggccagag agacattgct gccagccagc tctgccttcc catcatctcc tttcaggacc
2341 gtcccacacc ttttacttgc tcagtgctgt ctgaagatgc agttgctgtt tgcaaacaac
2401 aggaacacca gttaaactaa ttaggaaaca gagggagatt tccaggcctg ggtaactata
2461 tactgtgacc attggcggtt gagaccggtc ttcaaccagt ggaaccccga actctgctgt
2521 cagggtgtgg acttcggtgc tcttccaagt tttcacctgg ggggggagc taaccccta
2581 tgttcacgcc ttctattccc attggcgctg aactcttaag gtcactctgg tcgcttgtga
2641 ccccgtaacc ctgatgtacc cctctaaaag gtgaggggc
```

TABLE XXIIIB

Nucleotide sequence alignment of 193P1E1B v.1 with 193P1E1B v.4.

```
Score = 3698 bits (1923), Expect = 0.0 Identities = 1923/1923 (100%) Strand =
Plus/Plus (portion of SEQ ID NO: 1308)
193P1E1Bv.1:   1 tatcatctgtgactgaggaaatccctatcttcctatcagactaatgaaaccacaggacag   60
                 ||||||||||||||||||||||||||||||||||||||||||||||||||||||||||||
193P1E1Bv.4:   1 tatcatctgtgactgaggaaatccctatcttcctatcagactaatgaaaccacaggacag   60

(SEQ ID NO: 1311)

193P1E1Bv.1:  61 caattagacttttaagtattgggggtttagagctctagatattcgatatgcagactact  120
                 ||||||||||||||||||||||||||||||||||||||||||||||||||||||||||||
193P1E1Bv.4:  61 caattagacttttaagtattgggggtttagagctctagatattcgatatgcagactact  120

193P1E1Bv.1: 121 catgtttgtttgttttaataaagactggtccaaaggctcattttcacacaagctacagtt  180
                 ||||||||||||||||||||||||||||||||||||||||||||||||||||||||||||
193P1E1Bv.4: 121 catgtttgtttgttttaataaagactggtccaaaggctcattttcacacaagctacagtt  180
```

TABLE XXIIIB-continued

Nucleotide sequence alignment of 193P1E1B v.1 with 193P1E1B v.4.

```
193P1E1Bv.1:  181  tttcagttccaggaccaggtaaagatggtcagctccgtgatccataaaatccaagggtga  240
                   ||||||||||||||||||||||||||||||||||||||||||||||||||||||||||||
193P1E1Bv.4:  181  tttcagttccaggaccaggtaaagatggtcagctccgtgatccataaaatccaagggtga  240

193P1E1Bv.1:  241  cgactcaggattaggaccatttcttggtgacattgagatggtcgagctggtccgcaatga  300
                   ||||||||||||||||||||||||||||||||||||||||||||||||||||||||||||
193P1E1Bv.4:  241  cgactcaggattaggaccatttcttggtgacattgagatggtcgagctggtccgcaatga  300

193P1E1Bv.1:  301  atctatgcgggggggaacttggaagtggcggccgcctttatggcctcgaaggcctccctcc  360
                   ||||||||||||||||||||||||||||||||||||||||||||||||||||||||||||
193P1E1Bv.4:  301  atctatgcgggggggaacttggaagtggcggccgcctttatggcctcgaaggcctccctcc  360

193P1E1Bv.1:  361  tgcgcaccgcggcgtggccgcgctcctgctcccgggtcatgtagggcatgctcagccagt  420
                   ||||||||||||||||||||||||||||||||||||||||||||||||||||||||||||
193P1E1Bv.4:  361  tgcgcaccgcggcgtggccgcgctcctgctcccgggtcatgtagggcatgctcagccagt  420

193P1E1Bv.1:  421  aatggttctccgcctcgatctccaggcggcggatcatgttctgcttggcgcgcaacgaca  480
                   ||||||||||||||||||||||||||||||||||||||||||||||||||||||||||||
193P1E1Bv.4:  421  aatggttctccgcctcgatctccaggcggcggatcatgttctgcttggcgcgcaacgaca  480

193P1E1Bv.1:  481  cgaaccgcggccgccggtgcttcccgatccactgacggccgggaatgcggccgcgccaga  540
                   ||||||||||||||||||||||||||||||||||||||||||||||||||||||||||||
193P1E1Bv.4:  481  cgaaccgcggccgccggtgcttcccgatccactgacggccgggaatgcggccgcgccaga  540

193P1E1Bv.1:  541  ggagcgcagtcaggaacatggtgcctgccgcgctgctcaagactctgcgtctccgcggcc  600
                   ||||||||||||||||||||||||||||||||||||||||||||||||||||||||||||
193P1E1Bv.4:  541  ggagcgcagtcaggaacatggtgcctgccgcgctgctcaagactctgcgtctccgcggcc  600

193P1E1Bv.1:  601  gccagcagacgccgtggcgtaagcgcaccgtctcgcggggtctccgggggcctcggcga  660
                   ||||||||||||||||||||||||||||||||||||||||||||||||||||||||||||
193P1E1Bv.4:  601  gccagcagacgccgtggcgtaagcgcaccgtctcgcggggtctccgggggcctcggcga  660

193P1E1Bv.1:  661  gagacttcggctctcgcgagagaggactgcgcctgcgcagagccgaggacgcgtccggcg  720
                   ||||||||||||||||||||||||||||||||||||||||||||||||||||||||||||
193P1E1Bv.4:  661  gagacttcggctctcgcgagagaggactgcgcctgcgcagagccgaggacgcgtccggcg  720

193P1E1Bv.1:  721  ccgagattcaaactagtggcgggaggctgtgagctgagcggtggggtctgcgtacgcctg  780
                   ||||||||||||||||||||||||||||||||||||||||||||||||||||||||||||
193P1E1Bv.4:  721  ccgagattcaaactagtggcgggaggctgtgagctgagcggtggggtctgcgtacgcctg  780

193P1E1Bv.1:  781  gagtccttccccgctgtgctcagcatggaccctatccggagcttctgcgggaagctgcgg  840
                   ||||||||||||||||||||||||||||||||||||||||||||||||||||||||||||
193P1E1Bv.4:  781  gagtccttccccgctgtgctcagcatggaccctatccggagcttctgcgggaagctgcgg  840

193P1E1Bv.1:  841  tctctggccagcacgctggactgcgagacggcccggctgcagcgagcgctggacggagag  900
                   ||||||||||||||||||||||||||||||||||||||||||||||||||||||||||||
193P1E1Bv.4:  841  tctctggccagcacgctggactgcgagacggcccggctgcagcgagcgctggacggagag  900

193P1E1Bv.1:  901  gaaagcgactttgaagattatccaatgagaattttatatgaccttcattcagaagttcag  960
                   ||||||||||||||||||||||||||||||||||||||||||||||||||||||||||||
193P1E1Bv.4:  901  gaaagcgactttgaagattatccaatgagaattttatatgaccttcattcagaagttcag  960

193P1E1Bv.1:  961  actctaaaggatgatgttaatattcttcttgataaagcaagattggaaaatcaagaaggc  1020
                   ||||||||||||||||||||||||||||||||||||||||||||||||||||||||||||
193P1E1Bv.4:  961  actctaaaggatgatgttaatattcttcttgataaagcaagattggaaaatcaagaaggc  1020

193P1E1Bv.1: 1021  attgatttcataaaggcaacaaaagtactaatggaaaaaaattcaatggatattatgaaa  1080
                   ||||||||||||||||||||||||||||||||||||||||||||||||||||||||||||
193P1E1Bv.4: 1021  attgatttcataaaggcaacaaaagtactaatggaaaaaaattcaatggatattatgaaa  1080

193P1E1Bv.1: 1081  ataagagagtatttccagaagtatggatatagtccacgtgtcaagaaaaattcagtacac  1140
                   ||||||||||||||||||||||||||||||||||||||||||||||||||||||||||||
193P1E1Bv.4: 1081  ataagagagtatttccagaagtatggatatagtccacgtgtcaagaaaaattcagtacac  1140

193P1E1Bv.1: 1141  gagcaagaagccattaactctgacccagagttgtctaattgtgaaaattttcagaagact  1200
                   ||||||||||||||||||||||||||||||||||||||||||||||||||||||||||||
193P1E1Bv.4: 1141  gagcaagaagccattaactctgacccagagttgtctaattgtgaaaattttcagaagact  1200

193P1E1Bv.1: 1201  gatgtgaaagatgatctgtctgatcctcctgttgcaagcagttgtatttctgagaagtct  1260
                   ||||||||||||||||||||||||||||||||||||||||||||||||||||||||||||
193P1E1Bv.4: 1201  gatgtgaaagatgatctgtctgatcctcctgttgcaagcagttgtatttctgagaagtct  1260

193P1E1Bv.1: 1261  ccacgtagtccacaactttcagattttggacttgagcggtacatcgtatcccaagttcta  1320
                   ||||||||||||||||||||||||||||||||||||||||||||||||||||||||||||
193P1E1Bv.4: 1261  ccacgtagtccacaactttcagattttggacttgagcggtacatcgtatcccaagttcta  1320
```

TABLE XXIIIB-continued

Nucleotide sequence alignment of 193P1E1B v.1 with 193P1E1B v.4.

```
193P1E1Bv.1: 1321 ccaaaccctccacaggcagtgaacaactataaggaagagcccgtaattgtaaccccacct 1380
                  ||||||||||||||||||||||||||||||||||||||||||||||||||||||||||||
193P1E1Bv.4: 1321 ccaaaccctccacaggcagtgaacaactataaggaagagcccgtaattgtaaccccacct 1380

193P1E1Bv.1: 1381 accaaacaatcactagtaaaagtactaaaaactccaaaatgtgcactaaaaatggatgat 1440
                  ||||||||||||||||||||||||||||||||||||||||||||||||||||||||||||
193P1E1Bv.4: 1381 accaaacaatcactagtaaaagtactaaaaactccaaaatgtgcactaaaaatggatgat 1440

193P1E1Bv.1: 1441 tttgagtgtgtaactcctaaattagaacactttggtatctctgaatatactatgtgttta 1500
                  ||||||||||||||||||||||||||||||||||||||||||||||||||||||||||||
193P1E1Bv.4: 1441 tttgagtgtgtaactcctaaattagaacactttggtatctctgaatatactatgtgttta 1500

193P1E1Bv.1: 1501 aatgaagattacacaatgggacttaaaaatgcgaggaataataaaagtgaggaggccata 1560
                  ||||||||||||||||||||||||||||||||||||||||||||||||||||||||||||
193P1E1Bv.4: 1501 aatgaagattacacaatgggacttaaaaatgcgaggaataataaaagtgaggaggccata 1560

193P1E1Bv.1: 1561 gatacagaatccaggctcaatgataatgttttgccactcccagccccatcatccagcag 1620
                  ||||||||||||||||||||||||||||||||||||||||||||||||||||||||||||
193P1E1Bv.4: 1561 gatacagaatccaggctcaatgataatgttttgccactcccagccccatcatccagcag 1620

193P1E1Bv.1: 1621 ttggaaaaagtgatgccgaatataccaactctcctttggtacctacattctgtactcct 1680
                  ||||||||||||||||||||||||||||||||||||||||||||||||||||||||||||
193P1E1Bv.4: 1621 ttggaaaaagtgatgccgaatataccaactctcctttggtacctacattctgtactcct 1680

193P1E1Bv.1: 1681 ggtttgaaaattccatctacaaagaacagcatagctttggtatccacaaattacccatta 1740
                  ||||||||||||||||||||||||||||||||||||||||||||||||||||||||||||
193P1E1Bv.4: 1681 ggtttgaaaattccatctacaaagaacagcatagctttggtatccacaaattacccatta 1740

193P1E1Bv.1: 1741 tcaaaaacaaatagttcatcaaatgatttggaagttgaagatcgtacttcgttggttta 1800
                  ||||||||||||||||||||||||||||||||||||||||||||||||||||||||||||
193P1E1Bv.4: 1741 tcaaaaacaaatagttcatcaaatgatttggaagttgaagatcgtacttcgttggttta 1800

193P1E1Bv.1: 1801 aattcagacacatgctttgagaatttaacagatccctcttcacctacgatttcttcttat 1860
                  ||||||||||||||||||||||||||||||||||||||||||||||||||||||||||||
193P1E1Bv.4: 1801 aattcagacacatgctttgagaatttaacagatccctcttcacctacgatttcttcttat 1860

193P1E1Bv.1: 1861 gagaatctgctcagaacacctacacctccagaagtaactaaaattccagaagatattctc 1920
                  ||||||||||||||||||||||||||||||||||||||||||||||||||||||||||||
193P1E1Bv.4: 1861 gagaatctgctcagaacacctacacctccagaagtaactaaaattccagaagatattctc 1920

193P1E1Bv.1: 1921 cag                                                          1923
                  |||
193P1E1Bv.4: 1921 cag                                                          1923
```

Score = 1456 bits (757), Expect = 0.0 Identities = 757/757 (100%) Strand = Plus/Plus (portion of SEQ ID NO: 1308)

```
193P1E1Bv.1: 2042 gaaattccagtggatctatccaacacagaaactgaacaaaatgagatgaaagccgagctg 2101
                  ||||||||||||||||||||||||||||||||||||||||||||||||||||||||||||
193P1E1Bv.4: 1923 gaaattccagtggatctatccaacacagaaactgaacaaaatgagatgaaagccgagctg 1982
```

(SEQ ID NO: 1311 cont.)

```
193P1E1Bv.1: 2102 gaccgatttaacattcacattgccctgcctctgtccccctttaaacgttgacccatttt 2161
                  ||||||||||||||||||||||||||||||||||||||||||||||||||||||||||||
193P1E1Bv.4: 1983 gaccgatttaacattcacattgccctgcctctgtccccctttaaacgttgacccatttt 2042

193P1E1Bv.1: 2162 aaagacaaacatgaacattaacatcataatatgcttttatgaagtttcaataaggttta 2221
                  ||||||||||||||||||||||||||||||||||||||||||||||||||||||||||||
193P1E1Bv.4: 2043 aaagacaaacatgaacattaacatcataatatgcttttatgaagtttcaataaggttta 2102

193P1E1Bv.1: 2222 accttagtcttgttgacatgtagcccagtcattcactctttaaggactattagtgtttca 2281
                  ||||||||||||||||||||||||||||||||||||||||||||||||||||||||||||
193P1E1Bv.4: 2103 accttagtcttgttgacatgtagcccagtcattcactctttaaggactattagtgtttca 2162

193P1E1Bv.1: 2282 ttgatactaaattacccagcttaatcaacagaatggtttaagtagtaccaggaagtagga 2341
                  ||||||||||||||||||||||||||||||||||||||||||||||||||||||||||||
193P1E1Bv.4: 2163 ttgatactaaattacccagcttaatcaacagaatggtttaagtagtaccaggaagtagga 2222

193P1E1Bv.1: 2342 caagtaatttcaaaaatataaaggtgtttgctactcagatgaggccgcccctgaccttct 2401
                  ||||||||||||||||||||||||||||||||||||||||||||||||||||||||||||
193P1E1Bv.4: 2223 caagtaatttcaaaaatataaaggtgtttgctactcagatgaggccgcccctgaccttct 2282

193P1E1Bv.1: 2402 ggccagagagacattgctgccagccagctctgccttccatcatctccttcaggaccgt 2461
                  ||||||||||||||||||||||||||||||||||||||||||||||||||||||||||||
193P1E1Bv.4: 2283 ggccagagagacattgctgccagccagctctgccttccatcatctccttcaggaccgt 2342
```

TABLE XXIIIB-continued

Nucleotide sequence alignment of 193P1E1B v.1 with 193P1E1B v.4.

```
193P1E1Bv.1: 2462 cccacacctttttacttgctcagtgctgtctgaagatgcagttgctgtttgcaaacaacag 2521
                  ||||||||||||||||||||||||||||||||||||||||||||||||||||||||||||
193P1E1Bv.4: 2343 cccacacctttttacttgctcagtgctgtctgaagatgcagttgctgtttgcaaacaacag 2402

193P1E1Bv.1: 2522 gaacaccagttaaactaattaggaaacagagggagatttccaggcctgggtaactatata 2581
                  ||||||||||||||||||||||||||||||||||||||||||||||||||||||||||||
193P1E1Bv.4: 2403 gaacaccagttaaactaattaggaaacagagggagatttccaggcctgggtaactatata 2462

193P1E1Bv.1: 2582 ctgtgaccattggcggttgagaccggtcttcaaccagtggaaccccgaactctgctgtca 2641
                  ||||||||||||||||||||||||||||||||||||||||||||||||||||||||||||
193P1E1Bv.4: 2463 ctgtgaccattggcggttgagaccggtcttcaaccagtggaaccccgaactctgctgtca 2522

193P1E1Bv.1: 2642 gggtgtggacttcggtgctcttccaagttttcacctggggggggagctaaccccctatg 2701
                  ||||||||||||||||||||||||||||||||||||||||||||||||||||||||||||
193P1E1Bv.4: 2523 gggtgtggacttcggtgctcttccaagttttcacctggggggggagctaaccccctatg 2582

193P1E1Bv.1: 2702 ttcacgccttctattcccattggcgctgaactcttaaggtcactctggtcgcttgtgacc 2761
                  ||||||||||||||||||||||||||||||||||||||||||||||||||||||||||||
193P1E1Bv.4: 2583 ttcacgccttctattcccattggcgctgaactcttaaggtcactctggtcgcttgtgacc 2642

193P1E1Bv.1: 2762 ccgtaaccctgatgtaccctctaaaaggtgaggggc                          2798
                  ||||||||||||||||||||||||||||||||||||
193P1E1Bv.4: 2643 ccgtaaccctgatgtaccctctaaaaggtgaggggc                          2679
```

TABLE XXIVB

Amino acid sequence alignment of 193P1E1B v.1 and 193P1E1B v.4.
Score = 749 bits (1934), Expect = 0.0 Identities = 373/373 (100%), Positives = 373/373 (100%)

```
193P1E1Bv.1:         1 MDPIRSFCGKLRSLASTLDCETARLQRALDGEESDFEDYPMRILYDLHSEVQTLKDDVNI   60 (SEQ ID NO:1312)
                       MDPIRSFCGKLRSLASTLDCETARLQRALDGEESDFEDYPMRILYDLHSEVQTLKDDVNI
193P1E1Bv.4:         1 MDPIRSFCGKLRSLASTLDCETARLQRALDGEESDFEDYPMRILYDLHSEVQTLKDDVNI   60
(portion of SEQ
ID NO:1313)
193P1E1Bv.1:        61 LLDKARLENQEGIDFIKATKVLMEKNSMDIMKIREYFQKYGYSPRVKKNSVHEQEAINSD  120
                       LLDKARLENQEGIDFIKATKVLMEKNSMDIMKIREYFQKYGYSPRVKKNSVHEQEAINSD
193P1E1Bv.4:        61 LLDKARLENQEGIDFIKATKVLMEKNSMDIMKIREYFQKYGYSPRVKKNSVHEQEAINSD  120

193P1E1Bv.1:       121 PELSNCENFQKTDVKDDLSDPPVASSCISEKSPRSPQLSDFGLERYIVSQVLPNPPQAVN  180
                       PELSNCENFQKTDVKDDLSDPPVASSCISEKSPRSPQLSDFGLERYIVSQVLPNPPQAVN
193P1E1Bv.4:       121 PELSNCENFQKTDVKDDLSDPPVASSCISEKSPRSPQLSDFGLERYIVSQVLPNPPQAVN  180

193P1E1Bv.1:       181 NYKEEPVIVTPPTKQSLVKVLKTPKCALKMDDFECVTPKLEHFGISEYTMCLNEDYTMGL  240
                       NYKEEPVIVTPPTKQSLVKVLKTPKCALKMDDFECVTPKLEHFGISEYTMCLNEDYTMGL
193P1E1Bv.4:       181 NYKEEPVIVTPPTKQSLVKVLKTPKCALKMDDFECVTPKLEHFGISEYTMCLNEDYTMGL  240

193P1E1Bv.1:       241 KNARNNKSEEAIDTESRLNDNVFATPSPIIQQLEKSDAEYTNSPLVPTFCTPGLKIPSTK  300
                       KNARNNKSEEAIDTESRLNDNVFATPSPIIQQLEKSDAEYTNSPLVPTFCTPGLKIPSTK
193P1E1Bv.4:       241 KNARNNKSEEAIDTESRLNDNVFATPSPIIQQLEKSDAEYTNSPLVPTFCTPGLKIPSTK  300

193P1E1Bv.1:       301 NSIALVSTNYPLSKTNSSSNDLEVEDRTSLVLNSDTCFENLTDPSSPTISSYENLLRTPT  360
                       NSIALVSTNYPLSKTNSSSNDLEVEDRTSLVLNSDTCFENLTDPSSPTISSYENLLRTPT
193P1E1Bv.4:       301 NSIALVSTNYPLSKTNSSSNDLEVEDRTSLVLNSDTCFENLTDPSSPTISSYENLLRTPT  360

193P1E1Bv.1:       361 PPEVTKIPEDILQ  373
                       PPEVTKIPEDILQ
193P1E1Bv.4:       361 PPEVTKIPEDILQ  373
```

TABLE XXVB

Peptide sequence from the translation of the nucleotide sequence of
193P1E1B v.4. (SEQ ID NO:1313)

```
MDPIRSFCGK LRSLASTLDC ETARLQRALD GEESDFEDYP MRILYDLHSE VQTLKDDVNI    60

LLDKARLENQ EGIDFIKATK VLMEKNSMDI MKIREYFQKY GYSPRVKKNS VHEQEAINSD   120

PELSNCENFQ KTDVKDDLSD PPVASSCISE KSPRSPQLSD FGLERYIVSQ VLPNPPQAVN   180

NYKEEPVIVT PPTKQSLVKV LKTPKCALKM DDFECVTPKL EHFGISEYTM CLNEDYTMGL   240
```

TABLE XXVB-continued

Peptide sequence from the translation of the nucleotide sequence of 193P1E1B v.4. (SEQ ID NO:1313)

| | | | | | |
|---|---|---|---|---|---|
| KNARNNKSEE | AIDTESRLND | NVFATPSPII | QQLEKSDAEY | TNSPLVPTFC | TPGLKIPSTK 300 |
| NSIALVSTNY | PLSKTNSSSN | DLEVEDRTSL | VLNSDTCFEN | LTDPSSPTIS | SYENLLRTPT 360 |
| PPEVTKIPED | ILQKFQWIYP | TQKLNKMR | | | 388 |

TABLE XXIIC

Nucleotide sequence of 193P1E1B v.5. (SEQ ID NO:1314)

```
    1  tatcatctgt gactgaggaa atccctatct cctatcaga ctaatgaaac cacaggacag
   61  caattagact tttaagtatt gggggttta gagctctaga tattcgatat gcagactact
  121  catgtttgtt tgttttaata aagactggtc aaaggctca ttttcacaca agctacagtt
  181  tttcagttcc aggaccaggt aaagatggtc agctccgtga tccataaaat ccaagggtga
  241  cgactcagga ttaggaccat tcttggtga cattgagatg gtcgagctgg tccgcaatga
  301  atctatgcgg ggggaacttg gaagtggcgg ccgcctttat ggcctcgaag gctccctcc
  361  tgcgcaccgc ggcgtggccg cgctcctgct cccgggtcat gtagggcatg ctcagccagt
  421  aatggttctc cgcctcgatc tccaggcggc ggatcatgtt ctgcttggcg cgcaacgaca
  481  cgaaccgcgg ccgccggtgc ttcccgatcc actgacggcc gggaatgcgg ccgcgccaga
  541  ggagcgcagt caggaacatg gtgcctgccg cgctgctcaa gactctgcgt ctccgcggcc
  601  gccagcagac gccgtggcgt aagcgcaccc gtctcgcggg gtctccgggg gcctcggcga
  661  gagacttcgg ctctcgcgag agaggactgc gcctgcgcag agccgaggac gcgtccggcg
  721  ccgagattca aactagtggc gggaggctgt gagctgagcg gtggggtctg cgtacgcctg
  781  gagtccttcc ccgctgtgct cagcatggac cctatccgga gcttctgcgg gaagctgcgg
  841  tctctggcca gcacgctgga ctgcgagacg gcccggctgc agcgagcgct ggacggagag
  901  gaaagcggat gatgttaata ttcttcttga taaagcaaga ttggaaaatc aagaaggcat
  961  tgatttcata aaggcaacaa aagtactaat ggaaaaaaat tcaatggata ttatgaaaat
 1021  aagagagtat ttccagaagt atggatatag tccacgtgtc aagaaaaatt cagtacacga
 1081  gcaagaagcc attaactctg acccagagtt gtctaattgt gaaaattttc agaagactga
 1141  tgtgaaagat gatctgtctg atcctcctgt tgcaagcagt tgtatttctg agaagtctcc
 1201  acgtagtcca caactttcag attttggact tgagcggtac atcgtatccc aagttctacc
 1261  aaaccctcca caggcagtga acaactataa ggaagagccc gtaattgtaa ccccacctac
 1321  caaacaatca ctagtaaaag tactaaaaac tccaaaatgt gcactaaaaa tggatgattt
 1381  tgagtgtgta actcctaaat tagaacactt tggtatctct gaatatacta tgtgtttaaa
 1441  tgaagattac acaatgggac ttaaaaatgc gaggaataat aaaagtgagg aggccataga
 1501  tacagaatcc aggctcaatg ataatgtttt tgccactccc agccccatca tccagcagtt
 1561  ggaaaaaagt gatgccgaat ataccaactc tcctttggta cctacattct gtactcctgg
 1621  tttgaaaatt ccatctacaa agaacagcat agctttggta tccacaaatt acccattatc
 1681  aaaaacaaat agttcatcaa atgatttgga agttgaagat cgtacttcgt tggttttaaa
 1741  ttcagacaca tgctttgaga atttaacaga tccctcttca cctacgattt cttcttatga
 1801  gaatctgctc agaacaccta cacctccaga agtaactaaa attccagaag atattctcca
 1861  gaaattccag tggatctatc caacacagaa actgaacaaa atgagatgaa agccgagctg
```

TABLE XXIIC-continued

Nucleotide sequence of 193P1E1B v.5. (SEQ ID NO:1314)

```
1921 gaccgatttt aacattcaca ttgccctgcc tctgtccccc tttaaacgtt gacccatttt
1981 aaagacaaac atgaacatta acatcataat atgcttttta tgaagtttca ataaggttta
2041 accttagtct tgttgacatg tagcccagtc attcactctt taaggactat tagtgtttca
2101 ttgatactaa attacccagc ttaatcaaca gaatggttta agtagtacca ggaagtagga
2161 caagtaattt caaaaatata aaggtgtttg ctactcagat gaggccgccc ctgaccttct
2221 ggccagagag acattgctgc cagccagctc tgccttccca tcatctcctt tcaggaccgt
2281 cccacacctt ttacttgctc agtgctgtct gaagatgcag ttgctgtttg caaacaacag
2341 gaacaccagt taaactaatt aggaaacaga gggagatttc caggcctggg taactatata
2401 ctgtgaccat tggcggttga gaccggtctt caaccagtgg aaccccgaac tctgctgtca
2461 gggtgtggac ttcggtgctc ttccaagttt tcacctgggg ggggagcta accccctatg
2521 ttcacgcctt ctattcccat tggcgctgaa ctcttaaggt cactctggtc gcttgtgacc
2581 ccgtaaccct gatgtacccc tctaaaaggt gaggggc
```

TABLE XXIIIC

Nucleotide sequence alignment of 193P1E1B v.1 with 193P1E1B v.5.

Score = 1744 bits (907), Expect = 0.0 Identities = 907/907 (100%) Strand = Plus/Plus (portion of SEQ ID NO: 1308)

```
193P1E1Bv.1:    1 tatcatctgtgactgaggaaatccctatcttcctatcagactaatgaaaccacaggacag   60
                  ||||||||||||||||||||||||||||||||||||||||||||||||||||||||||||
193P1E1Bv.5:    1 tatcatctgtgactgaggaaatccctatcttcctatcagactaatgaaaccacaggacag   60

(SEQ ID NO: 1314)

193P1E1Bv.1:   61 caattagacttttaagtattgggggggtttagagctctagatattcgatatgcagactact  120
                  ||||||||||||||||||||||||||||||||||||||||||||||||||||||||||||
193P1E1Bv.5:   61 caattagacttttaagtattgggggggtttagagctctagatattcgatatgcagactact  120

193P1E1Bv.1:  121 catgtttgtttgttttaataaagactggtccaaaggctcattttcacacaagctacagtt  180
                  ||||||||||||||||||||||||||||||||||||||||||||||||||||||||||||
193P1E1Bv.5:  121 catgtttgtttgttttaataaagactggtccaaaggctcattttcacacaagctacagtt  180

193P1E1Bv.1:  181 tttcagttccaggaccaggtaaagatggtcagctccgtgatccataaaatccaagggtga  240
                  ||||||||||||||||||||||||||||||||||||||||||||||||||||||||||||
193P1E1Bv.5:  181 tttcagttccaggaccaggtaaagatggtcagctccgtgatccataaaatccaagggtga  240

193P1E1Bv.1:  241 cgactcaggattaggaccatttcttggtgacattgagatggtcgagctggtccgcaatga  300
                  ||||||||||||||||||||||||||||||||||||||||||||||||||||||||||||
193P1E1Bv.5:  241 cgactcaggattaggaccatttcttggtgacattgagatggtcgagctggtccgcaatga  300

193P1E1Bv.1:  301 atctatgcggggggaacttggaagtggcggccgcctttatggcctcgaaggcctccctcc  360
                  ||||||||||||||||||||||||||||||||||||||||||||||||||||||||||||
193P1E1Bv.5:  301 atctatgcggggggaacttggaagtggcggccgcctttatggcctcgaaggcctccctcc  360

193P1E1Bv.1:  361 tgcgcaccgcggcgtggccgcgctcctgctcccgggtcatgtagggcatgctcagccagt  420
                  ||||||||||||||||||||||||||||||||||||||||||||||||||||||||||||
193P1E1Bv.5:  361 tgcgcaccgcggcgtggccgcgctcctgctcccgggtcatgtagggcatgctcagccagt  420

193P1E1Bv.1:  421 aatggttctccgcctcgatctccaggcggcggatcatgttctgcttggcgcgcaacgaca  480
                  ||||||||||||||||||||||||||||||||||||||||||||||||||||||||||||
193P1E1Bv.5:  421 aatggttctccgcctcgatctccaggcggcggatcatgttctgcttggcgcgcaacgaca  480

193P1E1Bv.1:  481 cgaaccgcggccgccggtgcttcccgatccactgacggccgggaatgcggccgcgccaga  540
                  ||||||||||||||||||||||||||||||||||||||||||||||||||||||||||||
193P1E1Bv.5:  481 cgaaccgcggccgccggtgcttcccgatccactgacggccgggaatgcggccgcgccaga  540

193P1E1Bv.1:  541 ggagcgcagtcaggaacatggtgcctgccgcgctgctcaagactctgcgtctccgcggcc  600
                  ||||||||||||||||||||||||||||||||||||||||||||||||||||||||||||
193P1E1Bv.5:  541 ggagcgcagtcaggaacatggtgcctgccgcgctgctcaagactctgcgtctccgcggcc  600
```

TABLE XXIIIC-continued

Nucleotide sequence alignment of 193P1E1B v.1 with 193P1E1B v.5.

```
193P1E1Bv.1:  601 gccagcagacgccgtggcgtaagcgcacccgtctcgcggggtctccgggggcctcggcga  660
                  ||||||||||||||||||||||||||||||||||||||||||||||||||||||||||||
193P1E1Bv.5:  601 gccagcagacgccgtggcgtaagcgcacccgtctcgcggggtctccgggggcctcggcga  660

193P1E1Bv.1:  661 gagacttcggctctcgcgagagaggactgcgcctgcgcagagccgaggacgcgtccggcg  720
                  ||||||||||||||||||||||||||||||||||||||||||||||||||||||||||||
193P1E1Bv.5:  661 gagacttcggctctcgcgagagaggactgcgcctgcgcagagccgaggacgcgtccggcg  720

193P1E1Bv.1:  721 ccgagattcaaactagtggcgggaggctgtgagctgagcggtggggtctgcgtacgcctg  780
                  ||||||||||||||||||||||||||||||||||||||||||||||||||||||||||||
193P1E1Bv.5:  721 ccgagattcaaactagtggcgggaggctgtgagctgagcggtggggtctgcgtacgcctg  780

193P1E1Bv.1:  781 gagtccttccccgctgtgctcagcatggaccctatccggagcttctgcgggaagctgcgg  840
                  ||||||||||||||||||||||||||||||||||||||||||||||||||||||||||||
193P1E1Bv.5:  781 gagtccttccccgctgtgctcagcatggaccctatccggagcttctgcgggaagctgcgg  840

193P1E1Bv.1:  841 tctctggccagcacgctggactgcgagacggcccggctgcagcgagcgctggacggagag  900
                  ||||||||||||||||||||||||||||||||||||||||||||||||||||||||||||
193P1E1Bv.5:  841 tctctggccagcacgctggactgcgagacggcccggctgcagcgagcgctggacggagag  900

193P1E1Bv.1:  901 gaaagcg                                                       907
                  |||||||
193P1E1Bv.5:  901 gaaagcg                                                       907
```

Score = 1836 bits (955), Expect = 0.0 Identities = 955/955 (100%) Strand = Plus/Plus (portion of SEQ ID NO: 1308)

```
193P1E1Bv.1:  969 ggatgatgttaatattcttcttgataaagcaagattggaaaatcaagaaggcattgattt  1028
                  ||||||||||||||||||||||||||||||||||||||||||||||||||||||||||||
193P1E1Bv.5:  907 ggatgatgttaatattcttcttgataaagcaagattggaaaatcaagaaggcattgattt   966
```

(SEQ ID NO: 1314 cont.)

```
193P1E1Bv.1: 1029 cataaaggcaacaaaagtactaatggaaaaaaattcaatggatattatgaaaataagaga  1088
                  ||||||||||||||||||||||||||||||||||||||||||||||||||||||||||||
193P1E1Bv.5:  967 cataaaggcaacaaaagtactaatggaaaaaaattcaatggatattatgaaaataagaga  1026

193P1E1Bv.1: 1089 gtatttccagaagtatggatatagtccacgtgtcaagaaaaattcagtacacgagcaaga  1148
                  ||||||||||||||||||||||||||||||||||||||||||||||||||||||||||||
193P1E1Bv.5: 1027 gtatttccagaagtatggatatagtccacgtgtcaagaaaaattcagtacacgagcaaga  1086

193P1E1Bv.1: 1149 agccattaactctgacccagagttgtctaattgtgaaaattttcagaagactgatgtgaa  1208
                  ||||||||||||||||||||||||||||||||||||||||||||||||||||||||||||
193P1E1Bv.5: 1087 agccattaactctgacccagagttgtctaattgtgaaaattttcagaagactgatgtgaa  1146

193P1E1Bv.1: 1209 agatgatctgtctgatcctcctgttgcaagcagttgtatttctgagaagtctccacgtag  1268
                  ||||||||||||||||||||||||||||||||||||||||||||||||||||||||||||
193P1E1Bv.5: 1147 agatgatctgtctgatcctcctgttgcaagcagttgtatttctgagaagtctccacgtag  1206

193P1E1Bv.1: 1269 tccacaactttcagattttggacttgagcggtacatcgtatcccaagttctaccaaaccc  1328
                  ||||||||||||||||||||||||||||||||||||||||||||||||||||||||||||
193P1E1Bv.5: 1207 tccacaactttcagattttggacttgagcggtacatcgtatcccaagttctaccaaaccc  1266

193P1E1Bv.1: 1329 tccacaggcagtgaacaactataaggaagagcccgtaattgtaaccccacctaccaaaca  1388
                  ||||||||||||||||||||||||||||||||||||||||||||||||||||||||||||
193P1E1Bv.5: 1267 tccacaggcagtgaacaactataaggaagagcccgtaattgtaaccccacctaccaaaca  1326

193P1E1Bv.1: 1389 atcactagtaaaagtactaaaaactccaaaatgtgcactaaaaatggatgattttgagtg  1488
                  ||||||||||||||||||||||||||||||||||||||||||||||||||||||||||||
193P1E1Bv.5: 1327 atcactagtaaaagtactaaaaactccaaaatgtgcactaaaaatggatgattttgagtg  1386

193P1E1Bv.1: 1449 tgtaactcctaaattagaacactttggtatctctgaatatactatgtgtttaaatgaaga  1508
                  ||||||||||||||||||||||||||||||||||||||||||||||||||||||||||||
193P1E1Bv.5: 1387 tgtaactcctaaattagaacactttggtatctctgaatatactatgtgtttaaatgaaga  1446

193P1E1Bv.1: 1509 ttacacaatgggacttaaaaatgcgaggaataataaaagtgaggaggccatagatacaga  1568
                  ||||||||||||||||||||||||||||||||||||||||||||||||||||||||||||
193P1E1Bv.5: 1447 ttacacaatgggacttaaaaatgcgaggaataataaaagtgaggaggccatagatacaga  1506

193P1E1Bv.1: 1569 atccaggctcaatgataatgttttgccactcccagccccatcatccagcagttggaaaa   1628
                  ||||||||||||||||||||||||||||||||||||||||||||||||||||||||||||
193P1E1Bv.5: 1507 atccaggctcaatgataatgttttgccactcccagccccatcatccagcagttggaaaa   1566

193P1E1Bv.1: 1629 aagtgatgccgaatataccaactctcctttggtacctacattctgtactcctggtttgaa  1688
                  ||||||||||||||||||||||||||||||||||||||||||||||||||||||||||||
193P1E1Bv.5: 1567 aagtgatgccgaatataccaactctcctttggtacctacattctgtactcctggtttgaa  1626
```

TABLE XXIIIC-continued

Nucleotide sequence alignment of 193P1E1B v.1 with 193P1E1B v.5.

```
193P1E1Bv.1: 1689 aattccatctacaaagaacagcatagctttggtatccacaaattacccattatcaaaaac 1748
                  ||||||||||||||||||||||||||||||||||||||||||||||||||||||||||||
193P1E1Bv.5: 1627 aattccatctacaaagaacagcatagctttggtatccacaaattacccattatcaaaaac 1686

193P1E1Bv.1: 1749 aaatagttcatcaaatgatttggaagttgaagatcgtacttcgttggttttaaattcaga 1808
                  ||||||||||||||||||||||||||||||||||||||||||||||||||||||||||||
193P1E1Bv.5: 1687 aaatagttcatcaaatgatttggaagttgaagatcgtacttcgttggttttaaattcaga 1746

193P1E1Bv.1: 1809 cacatgctttgagaatttaacagatccctcttcacctacgatttcttcttatgagaatct 1868
                  ||||||||||||||||||||||||||||||||||||||||||||||||||||||||||||
193P1E1Bv.5: 1747 cacatgctttgagaatttaacagatccctcttcacctacgatttcttcttatgagaatct 1806

193P1E1Bv.1: 1869 gctcagaacacctacacctccagaagtaactaaaattccagaagatattctccag      1923
                  |||||||||||||||||||||||||||||||||||||||||||||||||||||||
193P1E1Bv.5: 1807 gctcagaacacctacacctccagaagtaactaaaattccagaagatattctccag      1861
```

Score = 1456 bits (757), Expect = 0.0 Identities = 757/757 (100%) Strand = Plus/Plus (portion of SEQ ID NO: 1308)

```
193P1E1Bv.1: 2042 gaaattccagtggatctatccaacacagaaactgaacaaaatgagatgaaagccgagctg 2101
                  ||||||||||||||||||||||||||||||||||||||||||||||||||||||||||||
193P1E1Bv.5: 1861 gaaattccagtggatctatccaacacagaaactgaacaaaatgagatgaaagccgagctg 1920
```

(SEQ ID NO: 1314 cont.)

```
193P1E1Bv.1: 2102 gaccgatttttaacattcacattgccctgcctctgtcccccttttaaacgttgacccatttt 2161
                  ||||||||||||||||||||||||||||||||||||||||||||||||||||||||||||
193P1E1Bv.5: 1921 gaccgatttttaacattcacattgccctgcctctgtcccccttttaaacgttgacccatttt 1980

193P1E1Bv.1: 2162 aaagacaaacatgaacattaacatcataatatgcttttatgaagtttcaataaggttta 2221
                  ||||||||||||||||||||||||||||||||||||||||||||||||||||||||||||
193P1E1Bv.5: 1981 aaagacaaacatgaacattaacatcataatatgcttttatgaagtttcaataaggttta 2040

193P1E1Bv.1: 2222 accttagtcttgttgacatgtagcccagtcattcactcttaaggactattagtgtttca 2281
                  ||||||||||||||||||||||||||||||||||||||||||||||||||||||||||||
193P1E1Bv.5: 2041 accttagtcttgttgacatgtagcccagtcattcactcttaaggactattagtgtttca 2100

193P1E1Bv.1: 2282 ttgatactaaattacccagcttaatcaacagaatggtttaagtagtaccaggaagtagga 2341
                  ||||||||||||||||||||||||||||||||||||||||||||||||||||||||||||
193P1E1Bv.5: 2101 ttgatactaaattacccagcttaatcaacagaatggtttaagtagtaccaggaagtagga 2160

193P1E1Bv.1: 2342 caagtaatttcaaaaatataaaggtgtttgctactcagatgaggccgcccctgaccttct 2401
                  ||||||||||||||||||||||||||||||||||||||||||||||||||||||||||||
193P1E1Bv.5: 2161 caagtaatttcaaaaatataaaggtgtttgctactcagatgaggccgcccctgaccttct 2220

193P1E1Bv.1: 2402 ggccagagagacattgctgccagccagctctgccttcccatcatctcctttcaggaccgt 2461
                  ||||||||||||||||||||||||||||||||||||||||||||||||||||||||||||
193P1E1Bv.5: 2221 ggccagagagacattgctgccagccagctctgccttcccatcatctcctttcaggaccgt 2280

193P1E1Bv.1: 2462 cccacacctttttacttgctcagtgctgtctgaagatgcagttgctgtttgcaaacaacag 2521
                  ||||||||||||||||||||||||||||||||||||||||||||||||||||||||||||
193P1E1Bv.5: 2281 cccacacctttttacttgctcagtgctgtctgaagatgcagttgctgtttgcaaacaacag 2340

193P1E1Bv.1: 2522 gaacaccagttaaactaattaggaaacagagggagatttccaggcctgggtaactatata 2581
                  ||||||||||||||||||||||||||||||||||||||||||||||||||||||||||||
193P1E1Bv.5: 2341 gaacaccagttaaactaattaggaaacagagggagatttccaggcctgggtaactatata 2400

193P1E1Bv.1: 2582 ctgtgaccattggcggttgagaccggtcttcaaccagtggaaccccgaactctgctgtca 2641
                  ||||||||||||||||||||||||||||||||||||||||||||||||||||||||||||
193P1E1Bv.5: 2401 ctgtgaccattggcggttgagaccggtcttcaaccagtggaaccccgaactctgctgtca 2460

193P1E1Bv.1: 2642 gggtgtggacttcggtgctcttccaagttttcacctggggggggagctaacccctatg   2701
                  ||||||||||||||||||||||||||||||||||||||||||||||||||||||||||||
193P1E1Bv.5: 2461 gggtgtggacttcggtgctcttccaagttttcacctggggggggagctaacccctatg   2520

193P1E1Bv.1: 2702 ttcacgccttctattcccattggcgctgaactcttaaggtcactctggtcgcttgtgacc 2761
                  ||||||||||||||||||||||||||||||||||||||||||||||||||||||||||||
193P1E1Bv.5: 2521 ttcacgccttctattcccattggcgctgaactcttaaggtcactctggtcgcttgtgacc 2580

193P1E1Bv.1: 2762 ccgtaaccctgatgtaccctctaaaaggtgagggc                          2798
                  |||||||||||||||||||||||||||||||||||
193P1E1Bv.5: 2581 ccgtaaccctgatgtaccctctaaaaggtgagggc                          2617
```

TABLE XXIVC

Amino acid sequence alignment of 193P1E1B v.1 and 193P1E1B v.5.
Score = 586 bits (1510), Expect = e-166 Identities = 290/291 (99%),
Positives = 290/291 (99%)

```
                                                    (portion of SEQ ID NO:1309)
193P1E1Bv.1:    83 MEKNSMDIMKIREYFQKYGYSPRVKKNSVHEQEAINSDPELSNCENFQKTDVKDDLSDPP 142
                   MEKNSMDIMKIREYFQKYGYSPRVKKNSVHEQEAINSDPELSNCENFQKTDVKDDLSDPP
193P1E1Bv.5:     1 MEKNSMDIMKIREYFQKYGYSPRVKKNSVHEQEAINSDPELSNCENFQKTDVKDDLSDPP  60

(portion of SEQ ID NO:1315)
193P1E1Bv.1:   143 VASSCISEKSPRSPQLSDFGLERYIVSQVLPNPPQAVNNYKEEPVIVTPPTKQSLVKVLK 202
                   VASSCIS KSPRSPQLSDFGLERYIVSQVLPNPPQAVNNYKEEPVIVTPPTKQSLVKVLK
193P1E1Bv.5:    61 VASSCISGKSPRSPQLSDFGLERYIVSQVLPNPPQAVNNYKEEPVIVTPPTKQSLVKVLK 120

193P1E1Bv.1:   203 TPKCALKMDDFECVTPKLEHFGISEYTMCLNEDYTMGLKNARNNKSEEAIDTESRLNDNV 262
                   TPKCALKMDDFECVTPKLEHFGISEYTMCLNEDYTMGLKNARNNKSEEAIDTESRLNDNV
193P1E1Bv.5:   121 TPKCALKMDDFECVTPKLEHFGISEYTMCLNEDYTMGLKNARNNKSEEAIDTESRLNDNV 180

193P1E1Bv.1:   263 FATPSPIIQQLEKSDAEYTNSPLVPTFCTPGLKIPSTKNSIALVSTNYPLSKTNSSSNDL 322
                   FATPSPIIQQLEKSDAEYTNSPLVPTFCTPGLKIPSTKNSIALVSTNYPLSKTNSSSNDL
193P1E1Bv.5:   181 FATPSPIIQQLEKSDAEYTNSPLVPTFCTPGLKIPSTKNSIALVSTNYPLSKTNSSSNDL 240

193P1E1Bv.1:   323 EVEDRTSLVLNSDTCFENLTDPSSPTISSYENLLRTPTPPEVTKIPEDILQ 373
                   EVEDRTSLVLNSDTCFENLTDPSSPTISSYENLLRTPTPPEVTKIPEDILQ
193P1E1Bv.5:   241 EVEDRTSLVLNSDTCFENLTDPSSPTISSYENLLRTPTPPEVTKIPEDILQ 291
```

TABLE XXVC

Peptide sequence from the translation of the nucleotide sequence of
193P1E1B v.5. (SEQ ID NO:1315)

```
MEKNSMDIMK IREYFQKYGY SPRVKKNSVH EQEAINSDPE LSNCENFQKT DVKDDLSDPP  60

VASSCISEKS PRSPQLSDFG LERYIVSQVL PNPPQAVNNY KEEPVIVTPP TKQSLVKVLK 120

TPKCALKMDD FECVTPKLEH FGISEYTMCL NEDYTMGLKN APNNKSEEAI DTESRLNDNV 180

FATPSPIIQQ LEKSDAEYTN SPLVPTFCTP GLKIPSTKNS IALVSTNYPL SKTNSSSNDL 240

EVEDRTSLVL NSDTCFENLT DPSSPTISSY ENLLRTPTPP EVTKIPEDIL QKFQWIYPTQ 300

KLNKMR                                                          306
```

TABLE XXIID

Nucleotide sequence of 193P1E1B v.6. (SEQ ID NO:1316)

```
  1 tatcatctgt gactgaggaa atccctatct tcctatcaga ctaatgaaac cacaggacag 61 caattagact tttaagtatt gggggggttta gagctctaga tattcgatat gcagactact 121 catgtttgtt tgttttaata aagactggtc caaaggctca ttttcacaca agctacagtt 181 tttcagttcc aggaccaggt aaagatggtc agctccgtga tccataaaat ccaagggtga 241 cgactcagga ttaggaccat tcttggtga cattgagatg gtcgagctgg tccgcaatga 301 atctatgcgg ggggaacttg gaagtggcgg ccgcctttat ggcctcgaag gcctccctcc 361 tgcgcaccgc ggcgtggccg cgctcctgct cccgggtcat gtagggcatg ctcagccagt 421 aatggttctc cgcctcgatc tccaggcggc ggatcatgtt ctgcttggcg cgcaacgaca 481 cgaaccgcgg ccgccggtgc ttcccgatcc actgacggcc gggaatgcgg ccgcgccaga 541 ggagcgcagt caggaacatg gtgcctgccg cgctgctcaa gactctgcgt ctccgcggcc 601 gccagcagac gccgtggcgt aagcgcaccc gtctcgcggg gtctccgggg gcctcggcga 661 gagacttcgg ctctcgcgag agaggactgc gcctgcgcag agccgaggac gcgtccggcg 721 ccgagattca aactagtggc gggaggctgt gagctgagcg gtggggtctg cgtacgcctg 781 gagtccttcc ccgctgtgct cagcatggac cctatccgga gcttctgcgg gaagctgcgg
```

TABLE XXIID-continued

Nucleotide sequence of 193P1E1B v.6. (SEQ ID NO:1316)

```
 841 tctctggcca gcacgctgga ctgcgagacg gcccggctgc agcgagcgct ggacggagag
 901 gaaagccttt tatcaaaata caactcaaac ctagctactc caatagcaat taaagcagtg
 961 ccacccagta aaaggttcct taaacatgga cagaacatcc gagatgtcag caacaaagaa
1021 aactgaaatt ccagtggatc tatccaacac agaaactgaa caaaatgaga tgaaagccga
1081 gctggaccga ttttaacatt cacattgccc tgcctctgtc ccccttttaaa cgttgaccca
1141 ttttaaagac aaacatgaac attaacatca taatatgctt tttatgaagt ttcaataagg
1201 tttaaccta gtcttgttga catgtagccc agtcattcac tctttaagga ctattagtgt
1261 ttcattgata ctaaattacc cagcttaatc aacagaatgg tttaagtagt accaggaagt
1321 aggacaagta atttcaaaaa tataaaggtg tttgctactc agatgaggcc gccctgacc
1381 ttctggccag agagacattg ctgccagcca gctctgcctt cccatcatct cctttcagga
1441 ccgtcccaca ccttttactt gctcagtgct gtctgaagat gcagttgctg tttgcaaaca
1501 acaggaacac cagttaaact aattaggaaa cagagggaga tttccaggcc tgggtaacta
1561 tatactgtga ccattggcgg ttgagaccgg tcttcaacca gtggaacccc gaactctgct
1621 gtcagggtgt ggacttcggt gctcttccaa gttttcacct ggggggggga gctaaccccc
1681 tatgttcacg ccttctattc ccattggcgc tgaactctta aggtcactct ggtcgcttgt
1741 gaccccgtaa ccctgatgta cccctctaaa aggtgagggg c
```

TABLE XXIIID

Nucleotide sequence alignment of 193P1E1B v.1 with 193P1E1B v.6.

Score = 1742 bits (906), Expect = 0.0 Identities = 906/906 (100%) Strand = Plus/Plus (portion of SEQ ID NO: 1308)

```
193P1E1Bv.1:   1 tatcatctgtgactgaggaaatccctatcttcctatcagactaatgaaaccacaggacag  60
                 ||||||||||||||||||||||||||||||||||||||||||||||||||||||||||||
193P1E1Bv.6:   1 tatcatctgtgactgaggaaatccctatcttcctatcagactaatgaaaccacaggacag  60
```

(SEQ ID NO: 1316)

```
193P1E1Bv.1:  61 caattagacttttaagtattggggggtttagagctctagatattcgatatgcagactact 120
                 ||||||||||||||||||||||||||||||||||||||||||||||||||||||||||||
193P1E1Bv.6:  61 caattagacttttaagtattggggggtttagagctctagatattcgatatgcagactact 120

193P1E1Bv.1: 121 catgtttgtttgttttaataaagactggtccaaaggctcattttcacacaagctacagtt 180
                 ||||||||||||||||||||||||||||||||||||||||||||||||||||||||||||
193P1E1Bv.6: 121 catgtttgtttgttttaataaagactggtccaaaggctcattttcacacaagctacagtt 180

193P1E1Bv.1: 181 tttcagttccaggaccaggtaaagatggtcagctccgtgatccataaaatccaagggtga 240
                 ||||||||||||||||||||||||||||||||||||||||||||||||||||||||||||
193P1E1Bv.6: 181 tttcagttccaggaccaggtaaagatggtcagctccgtgatccataaaatccaagggtga 240

193P1E1Bv.1: 241 cgactcaggattaggaccatttcttggtgacattgagatggtcgagctggtccgcaatga 300
                 ||||||||||||||||||||||||||||||||||||||||||||||||||||||||||||
193P1E1Bv.6: 241 cgactcaggattaggaccatttcttggtgacattgagatggtcgagctggtccgcaatga 300

193P1E1Bv.1: 301 atctatgcggggggaacttggaagtggcggccgcctttatggcctcgaaggcctccctcc 360
                 ||||||||||||||||||||||||||||||||||||||||||||||||||||||||||||
193P1E1Bv.6: 301 atctatgcggggggaacttggaagtggcggccgcctttatggcctcgaaggcctccctcc 360

193P1E1Bv.1: 361 tgcgcaccgcggcgtggccgcgctcctgctcccgggtcatgtagggcatgctcagccagt 420
                 ||||||||||||||||||||||||||||||||||||||||||||||||||||||||||||
193P1E1Bv.6: 361 tgcgcaccgcggcgtggccgcgctcctgctcccgggtcatgtagggcatgctcagccagt 420

193P1E1Bv.1: 421 aatggttctccgcctcgatctccaggcggcggatcatgttctgcttggcgcgcaacgaca 480
                 ||||||||||||||||||||||||||||||||||||||||||||||||||||||||||||
193P1E1Bv.6: 421 aatggttctccgcctcgatctccaggcggcggatcatgttctgcttggcgcgcaacgaca 480
```

TABLE XXIIID-continued

Nucleotide sequence alignment of 193P1E1B v.1 with 193P1E1B v.6.

```
193P1E1Bv.1:  481 cgaaccgcggccgccggtgcttcccgatccactgacggccgggaatgcggccgcgccaga  540
                  ||||||||||||||||||||||||||||||||||||||||||||||||||||||||||||
193P1E1Bv.6:  481 cgaaccgcggccgccggtgcttcccgatccactgacggccgggaatgcggccgcgccaga  540

193P1E1Bv.1:  541 ggagcgcagtcaggaacatggtgcctgccgcgctgctcaagactctgcgtctccgcggcc  600
                  ||||||||||||||||||||||||||||||||||||||||||||||||||||||||||||
193P1E1Bv.6:  541 ggagcgcagtcaggaacatggtgcctgccgcgctgctcaagactctgcgtctccgcggcc  600

193P1E1Bv.1:  601 gccagcagacgccgtggcgtaagcgcacccgtctcgcggggtctccgggggcctcggcga  660
                  ||||||||||||||||||||||||||||||||||||||||||||||||||||||||||||
193P1E1Bv.6:  601 gccagcagacgccgtggcgtaagcgcacccgtctcgcggggtctccgggggcctcggcga  660

193P1E1Bv.1:  661 gagacttcggctctcgcgagagaggactgcgcctgcgcagagccgaggacgcgtccggcg  720
                  ||||||||||||||||||||||||||||||||||||||||||||||||||||||||||||
193P1E1Bv.6:  661 gagacttcggctctcgcgagagaggactgcgcctgcgcagagccgaggacgcgtccggcg  720

193P1E1Bv.1:  721 ccgagattcaaactagtggcgggaggctgtgagctgagcggtggggtctgcgtacgcctg  780
                  ||||||||||||||||||||||||||||||||||||||||||||||||||||||||||||
193P1E1Bv.6:  721 ccgagattcaaactagtggcgggaggctgtgagctgagcggtggggtctgcgtacgcctg  780

193P1E1Bv.1:  781 gagtccttccccgctgtgctcagcatggaccctatccggagcttctgcgggaagctgcgg  840
                  ||||||||||||||||||||||||||||||||||||||||||||||||||||||||||||
193P1E1Bv.6:  781 gagtccttccccgctgtgctcagcatggaccctatccggagcttctgcgggaagctgcgg  840

193P1E1Bv.1:  841 tctctggccagcacgctggactgcgagacggcccggctgcagcgagcgctggacggagag  900
                  ||||||||||||||||||||||||||||||||||||||||||||||||||||||||||||
193P1E1Bv.6:  841 tctctggccagcacgctggactgcgagacggcccggctgcagcgagcgctggacggagag  900

193P1E1Bv.1:  901 gaaagc  906
                  ||||||
193P1E1Bv.6:  901 gaaagc  906
```

Score = 1683 bits (875), Expect = 0.0 Identities = 875/875 (100%) Strand = Plus/Plus (portion of SEQ ID NO: 1308)

```
193P1E1Bv.1: 1924 tttcagttccaggaccaggtaaagatggtcagctccgtgatccataaaatccaagggtga 1983
                  ||||||||||||||||||||||||||||||||||||||||||||||||||||||||||||
193P1E1Bv.6:  907 cttttatcaaaatacaactcaaacctagctactccaatagcaattaaagcagtgccaccc  966
```

(SEQ ID NO: 1316 cont.)

```
193P1E1Bv.1: 1984 agtaaaaggttccttaaacatggacagaacatccgagatgtcagcaacaaagaaaactga 2043
                  ||||||||||||||||||||||||||||||||||||||||||||||||||||||||||||
193P1E1Bv.6:  967 agtaaaaggttccttaaacatggacagaacatccgagatgtcagcaacaaagaaaactga 1026

193P1E1Bv.1: 2044 aattccagtggatctatccaacacagaaactgaacaaaatgagatgaaagccgagctgga 2103
                  ||||||||||||||||||||||||||||||||||||||||||||||||||||||||||||
193P1E1Bv.6: 1027 aattccagtggatctatccaacacagaaactgaacaaaatgagatgaaagccgagctgga 1086

193P1E1Bv.1: 2104 ccgattttaacattcacattgccctgcctctgtccccctttaaacgttgacccatttttaa 2163
                  ||||||||||||||||||||||||||||||||||||||||||||||||||||||||||||
193P1E1Bv.6: 1087 ccgattttaacattcacattgccctgcctctgtccccctttaaacgttgacccatttttaa 1146

193P1E1Bv.1: 2164 agacaaacatgaacattaacatcataatatgcttttatgaagtttcaataaggtttaac  2223
                  ||||||||||||||||||||||||||||||||||||||||||||||||||||||||||||
193P1E1Bv.6: 1147 agacaaacatgaacattaacatcataatatgcttttatgaagtttcaataaggtttaac  1206

193P1E1Bv.1: 2224 cttagtcttgttgacatgtagcccagtcattcactctttaaggactattagtgtttcatt 2283
                  ||||||||||||||||||||||||||||||||||||||||||||||||||||||||||||
193P1E1Bv.6: 1207 cttagtcttgttgacatgtagcccagtcattcactctttaaggactattagtgtttcatt 1266

193P1E1Bv.1: 2284 gatactaaattacccagcttaatcaacagaatggtttaagtagtaccaggaagtaggaca 2343
                  ||||||||||||||||||||||||||||||||||||||||||||||||||||||||||||
193P1E1Bv.6: 1267 gatactaaattacccagcttaatcaacagaatggtttaagtagtaccaggaagtaggaca 1326

193P1E1Bv.1: 2344 agtaatttcaaaaatataaaggtgtttgctactcagatgaggccgcccctgaccttctgg 2403
                  ||||||||||||||||||||||||||||||||||||||||||||||||||||||||||||
193P1E1Bv.6: 1327 agtaatttcaaaaatataaaggtgtttgctactcagatgaggccgcccctgaccttctgg 1386

193P1E1Bv.1: 2404 ccagagagacattgctgccagccagctctgccttcccatcatctccttcaggaccgtcc  2463
                  ||||||||||||||||||||||||||||||||||||||||||||||||||||||||||||
193P1E1Bv.6: 1387 ccagagagacattgctgccagccagctctgccttcccatcatctccttcaggaccgtcc  1446

193P1E1Bv.1: 2464 cacaccttttacttgctcagtgctgtctgaagatgcagttgctgtttgcaaacaacagga 2523
                  ||||||||||||||||||||||||||||||||||||||||||||||||||||||||||||
193P1E1Bv.6: 1447 cacaccttttacttgctcagtgctgtctgaagatgcagttgctgtttgcaaacaacagga 1506
```

TABLE XXIIID-continued

Nucleotide sequence alignment of 193P1E1B v.1 with 193P1E1B v.6.

```
193P1E1Bv.1: 2524 acaccagttaaactaattaggaaacagagggagatttccaggcctgggtaactatatact 2583
                  ||||||||||||||||||||||||||||||||||||||||||||||||||||||||||||
193P1E1Bv.6: 1507 acaccagttaaactaattaggaaacagagggagatttccaggcctgggtaactatatact 1566

193P1E1Bv.1: 2584 gtgaccattggcggttgagaccggtcttcaaccagtggaaccccgaactctgctgtcagg 2643
                  ||||||||||||||||||||||||||||||||||||||||||||||||||||||||||||
193P1E1Bv.6: 1567 gtgaccattggcggttgagaccggtcttcaaccagtggaaccccgaactctgctgtcagg 1626

193P1E1Bv.1: 2644 gtgtggacttcggtgctcttccaagttttcacctgggggggggagctaaccccctatgtt 2703
                  ||||||||||||||||||||||||||||||||||||||||||||||||||||||||||||
193P1E1Bv.6: 1627 gtgtggacttcggtgctcttccaagttttcacctgggggggggagctaaccccctatgtt 1686

193P1E1Bv.1: 2704 cacgccttctattcccattggcgctgaactcttaaggtcactctggtcgcttgtgacccc 2763
                  ||||||||||||||||||||||||||||||||||||||||||||||||||||||||||||
193P1E1Bv.6: 1687 cacgccttctattcccattggcgctgaactcttaaggtcactctggtcgcttgtgacccc 1746

193P1E1Bv.1: 2764 gtaaccctgatgtaccctctaaaaggtgaggggc                            2798
                  ||||||||||||||||||||||||||||||||||
193P1E1Bv.6: 1747 gtaaccctgatgtaccctctaaaaggtgaggggc                            1781
```

TABLE XXIVD

Amino acid sequence alignment of 193P1E1B v.1 and 193P1E1B v.6.

Score = 72.0 bits (175), Expect = 1e-11 Identities = 35/39 (89%), Positives = 35/39 (89%)

(portion of SEQ ID NO:1312)
```
193P1E1Bv.1:    1 MDPIRSFCGKLRSLASTLDCETARLQRALDGEESDFEDY 39
                  MDPIRSFCGKLRSLASTLDCETARLQRALDGEES    Y
193P1E1Bv.6:    1 MDPIRSFCGKLRSLASTLDCETARLQRALDGEESLLSKY 39
                                          (portion of SEQ ID NO:1317)
```

Score = 80.9 bits (198), Expect = 2e-14 Identities = 39/39 (100%), Positives = 39/39 (100%)

(portion of SEQ ID NO:1309)
```
193P1E1Bv.1:  374 LLSKYNSNLATPIAIKAVPPSKRFLKHGQNIRDVSNKEN 412
                  LLSKYNSNLATPIAIKAVPPSKRFLKHGQNIRDVSNKEN
193P1E1Bv.6:   35 LLSKYNSNLATPIAIKAVPPSKRFLKHGQNIRDVSNKEN  73
                                          (portion of SEQ ID NO:1317)
```

TABLE XXVD

Peptide sequence trom the translation ot the nucleotide sequence of 193P1E1B v.6. (SEQ ID NO:1317)

```
MDPIRSFCGK LRSLASTLDC ETARLQRALD GEESLLSKYN SNLATPIAIK AVPPSKRFLK 60

HGQNIRDVSN KEN                                                   73
```

TABLE 26

| Pos | | score |
|---|---|---|

MHC Class 1 nonamer and decamer analysis of 193P1E1b variant 1 for selected alleles. Listed are scores that fall within the top 50% (rounded up) of all scores for the selected allele.

(SEQ ID NOS 1318-1419, respectively, in order of appearance)
HLA-A*0201 nonamers

|  | 1 2 3 4 5 6 7 8 9 |  |
|---|---|---|
| 43 | I L Y D L $\underline{H}$ S E V | 27 |

TABLE 26-continued

| Pos | | score |
|---|---|---|
| 366 | K I P E D $\underline{I}$ L Q L | 26 |
| 46 | D L H S E $\underline{V}$ Q T L | 25 |
| 53 | T L K D D $\underline{V}$ N I L | 25 |
| 10 | K L R S L $\underline{A}$ S T L | 24 |
| 17 | T L D C E $\underline{T}$ A R L | 24 |
| 224 | G I S E Y $\underline{T}$ M C L | 24 |

TABLE 26-continued

| Pos | | score |
|---|---|---|
| 171 | V L P N P P Q A V | 23 |
| 304 | A L V S T N Y P L | 23 |
| 374 | L L S K Y N S N L | 23 |
| 59 | N I L L D K A R L | 22 |
| 200 | V L K T P K C A L | 22 |
| 6 | S F C G K L R S L | 21 |
| 257 | R L N D N V F A T | 21 |
| 298 | S T K N S I A L V | 21 |
| 295 | K I P S T K N S I | 20 |
| 348 | T I S S Y E N L L | 20 |
| 383 | A T P I A I K A V | 20 |
| 162 | G L E R Y I V S Q | 19 |
| 189 | V T P P T K Q S L | 19 |
| 341 | L T D P S S P T I | 19 |
| 381 | N L A T P I A I K | 19 |
| 3 | P I R S F C G K L | 18 |
| 13 | S L A S T L D C E | 18 |
| 39 | Y P M R I L Y D L | 18 |
| 192 | P T K Q S L V K V | 18 |
| 280 | Y T N S P L V P T | 18 |
| 390 | A V P P S K R F L | 18 |
| 82 | L M E K N S M D I | 17 |
| 196 | S L V K V L K T P | 17 |
| 307 | S T N Y P L S K T | 17 |
| 314 | K T N S S S N D L | 17 |
| 359 | P T P P E V T K I | 17 |
| 42 | R I L Y D L H S E | 16 |
| 52 | Q T L K D D V N I | 16 |
| 60 | I L L D K A R L E | 16 |
| 73 | I D F I K A T K V | 16 |
| 103 | S P R V K K N S V | 16 |
| 115 | E A I N S D P E L | 16 |
| 232 | L N E D Y T M G L | 16 |
| 265 | T P S P I I Q Q L | 16 |
| 322 | L E V E D R T S L | 16 |
| 355 | L L R T P T P P E | 16 |
| 356 | L R T P T P P E V | 16 |
| 367 | I P E D I L Q L L | 16 |

TABLE 26-continued

| Pos | | score |
|---|---|---|
| 370 | D I L Q L L S K Y | 16 |
| 373 | Q L L S K Y N S N | 16 |
| 9 | G K L R S L A S T | 15 |
| 21 | E T A R L Q R A L | 15 |
| 24 | R L Q R A L D G E | 15 |
| 57 | D V N I L L D K A | 15 |
| 61 | L L D K A R L E N | 15 |
| 65 | A R L E N Q E G I | 15 |
| 81 | V L M E K N S M D | 15 |
| 85 | K N S M D I M K I | 15 |
| 98 | Q K Y G Y S P R V | 15 |
| 157 | Q L S D F G L E R | 15 |
| 163 | L E R Y I V S Q V | 15 |
| 166 | Y I V S Q V L P N | 15 |
| 209 | K M D D F E C V T | 15 |
| 340 | N L T D P S S P T | 15 |
| 364 | V T K I P E D I L | 15 |
| 399 | K H G Q N I R D V | 15 |
| 28 | A L D G E E S D F | 14 |
| 75 | F I K A T K V L M | 14 |
| 80 | K V L M E K N S M | 14 |
| 92 | K I R E Y F Q K Y | 14 |
| 137 | D L S D P P V A S | 14 |
| 159 | S D F G L E R Y I | 14 |
| 193 | T K Q S L V K V L | 14 |
| 195 | Q S L V K V L K T | 14 |
| 208 | L K M D D F E C V | 14 |
| 250 | E A I D T E S R L | 14 |
| 278 | A E Y T N S P L V | 14 |
| 329 | S L V L N S D T C | 14 |
| 331 | V L N S D T C F E | 14 |
| 350 | S S Y E N L L R T | 14 |
| 14 | L A S T L D C E T | 13 |
| 54 | L K D D V N I L L | 13 |
| 68 | E N Q E G I D F I | 13 |
| 138 | L S D P P V A S S | 13 |
| 155 | S P Q L S D F G L | 13 |
| 170 | Q V L P N P P Q A | 13 |
| 181 | N Y K E E P V I V | 13 |

TABLE 26-continued

| Pos | | score |
|---|---|---|
| 207 | A L K M D D F E C | 13 |
| 212 | D F E C V T P K L | 13 |
| 219 | K L E H F G I S E | 13 |
| 231 | C L N E D Y T M G | 13 |
| 261 | N V F A T P S P I | 13 |
| 262 | V F A T P S P I I | 13 |
| 268 | P I I Q Q L E K S | 13 |
| 272 | Q L E K S D A E Y | 13 |
| 286 | V P T F C T P G L | 13 |
| 293 | G L K I P S T K N | 13 |
| 300 | K N S I A L V S T | 13 |
| 316 | N S S S N D L E V | 13 |
| 323 | E V E D R T S L V | 13 |
| 347 | P T I S S Y E N L | 13 |
| 380 | S N L A T P I A I | 13 |
| 382 | L A T P I A I K A | 13 |
| 386 | I A I K A V P P S | 13 |
| 397 | F L K H G Q N I R | 13 |

(SEQ ID NOS 1420-1436, respectively, in order of appearance)
HLA-A*0203 nonamers 1 2 3 4 5 6 7 8 9

| 382 | L A T P I A I K A | 11 |
|---|---|---|
| 15 | A S T L D C E T A | 10 |
| 243 | A R N N K S E E A | 10 |
| 7 | F C G K L R S L A | 9 |
| 20 | C E T A R L Q R A | 9 |
| 57 | D V N I L L D K A | 9 |
| 70 | Q E G I D F I K A | 9 |
| 108 | K N S V H E Q E A | 9 |
| 136 | D D L S D P P V A | 9 |
| 170 | Q V L P N P P Q A | 9 |
| 199 | K V L K T P K C A | 9 |
| 235 | D Y T M G L K N A | 9 |
| 256 | S R L N D N V F A | 9 |
| 270 | I Q Q L E K S D A | 9 |
| 296 | I P S T K N S I A | 9 |
| 375 | L S K Y N S N L A | 9 |
| 379 | N S N L A T P I A | 9 |

TABLE 26-continued

| Pos | | score |
|---|---|---|

(SEQ ID NOS 1437-1469, respectively, in order of appearance)
HLA-A1 nonamers 1 2 3 4 5 6 7 8 9

| 158 | L S D F G L E R Y | 31 |
|---|---|---|
| 31 | G E E S D F E D Y | 28 |
| 37 | E D Y P M R I L Y | 26 |
| 272 | Q L E K S D A E Y | 26 |
| 48 | H S E V Q T L K D | 24 |
| 228 | Y T M C L N E D Y | 24 |
| 344 | P S S P T I S S Y | 23 |
| 92 | K I R E Y F Q K Y | 21 |
| 138 | L S D P P V A S S | 20 |
| 341 | L T D P S S P T I | 20 |
| 54 | L K D D V N I L L | 19 |
| 182 | Y K E E P V I V T | 19 |
| 302 | S I A L V S T N Y | 19 |
| 55 | K D D V N I L L D | 18 |
| 61 | L L D K A R L E N | 18 |
| 118 | N S D P E L S N C | 18 |
| 131 | K T D V K D D L S | 18 |
| 324 | V E D R T S L V L | 18 |
| 368 | P E D I L Q L L S | 18 |
| 19 | D C E T A R L Q R | 17 |
| 94 | R E Y F Q K Y G Y | 17 |
| 220 | L E H F G I S E Y | 17 |
| 333 | N S D T C F E N L | 17 |
| 370 | D I L Q L L S K Y | 17 |
| 87 | S M D I M K I R E | 16 |
| 174 | N P P Q A V N N Y | 16 |
| 183 | K E E P V I V T P | 16 |
| 219 | K L E H F G I S E | 16 |
| 225 | I S E Y T M C L N | 16 |
| 253 | D T E S R L N D N | 16 |
| 88 | M D I M K I R E Y | 15 |
| 111 | V H E Q E A I N S | 15 |
| 258 | L N D N V F A T P | 15 |

TABLE 26-continued (SEQ ID NOS 1470-1525, respectively, in order of appearance)
HLA-A26 nonamers 1 2 3 4 5 6 7 8 9

| Pos | | score |
|---|---|---|
| 370 | D I L Q L L S K Y | 34 |
| 46 | D L H S E V Q T L | 28 |
| 92 | K I R E Y F Q K Y | 28 |
| 215 | C V T P K L E H F | 28 |
| 21 | E T A R L Q R A L | 27 |
| 89 | D I M K I R E Y F | 27 |
| 347 | P T I S S Y E N L | 27 |
| 366 | K I P E D I L Q L | 26 |
| 74 | D F I K A T K V L | 23 |
| 133 | D V K D D L S D P | 23 |
| 189 | V T P P T K Q S L | 23 |
| 6 | S F C G K L R S L | 22 |
| 28 | A L D G E E S D F | 22 |
| 53 | T L K D D V N I L | 22 |
| 57 | D V N I L L D K A | 22 |
| 212 | D F E C V T P K L | 22 |
| 272 | Q L E K S D A E Y | 22 |
| 302 | S I A L V S T N Y | 22 |
| 390 | A V P P S K R F L | 22 |
| 202 | K T P K C A L K M | 21 |
| 224 | G I S E Y T M C L | 21 |
| 228 | Y T M C L N E D Y | 21 |
| 253 | D T E S R L N D N | 21 |
| 330 | L V L N S D T C F | 21 |
| 3 | P I R S F C G K L | 20 |
| 59 | N I L L D K A R L | 20 |
| 75 | F I K A T K V L M | 20 |
| 314 | K T N S S S N D L | 20 |
| 10 | K L R S L A S T L | 19 |
| 17 | T L D C E T A R L | 19 |
| 80 | K V L M E K N S M | 19 |
| 115 | E A I N S D P E L | 19 |
| 192 | P T K Q S L V K V | 19 |
| 250 | E A I D T E S R L | 19 |
| 268 | P I I Q Q L E K S | 19 |
| 348 | T I S S Y E N L L | 19 |

TABLE 26-continued

| Pos | | score |
|---|---|---|
| 364 | V T K I P E D I L | 19 |
| 374 | L L S K Y N S N L | 19 |
| 37 | E D Y P M R I L Y | 18 |
| 88 | M D I M K I R E Y | 18 |
| 150 | E K S P R S P Q L | 18 |
| 153 | P R S P Q L S D F | 18 |
| 200 | V L K T P K C A L | 18 |
| 281 | T N S P L V P T F | 18 |
| 323 | E V E D R T S L V | 18 |
| 344 | P S S P T I S S Y | 18 |
| 359 | P T P P E V T K I | 18 |
| 50 | E V Q T L K D D V | 17 |
| 78 | A T K V L M E K N | 17 |
| 137 | D L S D P P V A S | 17 |
| 167 | I V S Q V L P N P | 17 |
| 174 | N P P Q A V N N Y | 17 |
| 264 | A T P S P I I Q Q | 17 |
| 298 | S T K N S I A L V | 17 |
| 304 | A L V S T N Y P L | 17 |
| 363 | E V T K I P E D I | 17 |

(SEQ ID NOS 1526-1597, respectively, in order of appearance)
HLA-A3 nonamers 1 2 3 4 5 6 7 8 9

| Pos | | score |
|---|---|---|
| 186 | P V I V T P P T K | 28 |
| 387 | A I K A V P P S K | 28 |
| 10 | K L R S L A S T L | 26 |
| 72 | G I D F I K A T K | 25 |
| 381 | N L A T P I A I K | 24 |
| 157 | Q L S D F G L E R | 23 |
| 239 | G L K N A R N N K | 23 |
| 28 | A L D G E E S D F | 22 |
| 197 | L V K V L K T P K | 22 |
| 92 | K I R E Y F Q K Y | 21 |
| 170 | Q V L P N P P Q A | 21 |
| 272 | Q L E K S D A E Y | 21 |
| 358 | T P T P P E V T K | 21 |
| 402 | Q N I R D V S N K | 21 |
| 43 | I L Y D L H S E V | 20 |

TABLE 26-continued

| Pos | | score |
|---|---|---|
| 292 | P G L K I P S T K | 20 |
| 60 | I L L D K A R L E | 19 |
| 91 | M K I R E Y F Q K | 19 |
| 100 | Y G Y S P R V K K | 19 |
| 105 | R V K K N S V H E | 19 |
| 162 | G L E R Y I V S Q | 19 |
| 194 | K Q S L V K V L K | 19 |
| 302 | S I A L V S T N Y | 19 |
| 369 | E D I L Q L L S K | 19 |
| 370 | D I L Q L L S K Y | 19 |
| 99 | K Y G Y S P R V K | 18 |
| 188 | I V T P P T K Q S | 18 |
| 215 | C V T P K L E H F | 18 |
| 219 | K L E H F G I S E | 18 |
| 267 | S P I I Q Q L E K | 18 |
| 330 | L V L N S D T C F | 18 |
| 366 | K I P E D I L Q L | 18 |
| 385 | P I A I K A V P P | 18 |
| 24 | R L Q R A L D G E | 17 |
| 80 | K V L M E K N S M | 17 |
| 137 | D L S D P P V A S | 17 |
| 191 | P P T K Q S L V K | 17 |
| 201 | L K T P K C A L K | 17 |
| 284 | P L V P T F C T P | 17 |
| 306 | V S T N Y P L S K | 17 |
| 354 | N L L R T P T P P | 17 |
| 373 | Q L L S K Y N S N | 17 |
| 397 | F L K H G Q N I R | 17 |
| 2 | D P I R S F C G K | 16 |
| 42 | R I L Y D L H S E | 16 |
| 66 | R L E N Q E G I D | 16 |
| 81 | V L M E K N S M D | 16 |
| 196 | S L V K V L K T P | 16 |
| 199 | K V L K T P K C A | 16 |
| 257 | R L N D N V F A T | 16 |
| 261 | N V F A T P S P I | 16 |
| 323 | E V E D R T S L V | 16 |
| 329 | S L V L N S D T C | 16 |
| 390 | A V P P S K R F L | 16 |

TABLE 26-continued

| Pos | | score |
|---|---|---|
| 75 | F I K A T K V L M | 15 |
| 77 | K A T K V L M E K | 15 |
| 110 | S V H E Q E A I N | 15 |
| 127 | E N F Q K T D V K | 15 |
| 133 | D V K D D L S D P | 15 |
| 183 | K E E P V I V T P | 15 |
| 311 | P L S K T N S S S | 15 |
| 37 | E D Y P M R I L Y | 14 |
| 46 | D L H S E V Q T L | 14 |
| 56 | D D V N I L L D K | 14 |
| 59 | N I L L D K A R L | 14 |
| 61 | L L D K A R L E N | 14 |
| 94 | R E Y F Q K Y G Y | 14 |
| 178 | A V N N Y K E E P | 14 |
| 207 | A L K M D D F E C | 14 |
| 321 | D L E V E D R T S | 14 |
| 340 | N L T D P S S P T | 14 |
| 344 | P S S P T I S S Y | 14 |

(SEQ ID NOS 1598-1668, respectively, in order of appearance)
HLA-B*0702 nonamers 1 2 3 4 5 6 7 8 9

| 265 | T P S P I I Q Q L | 23 |
| 286 | V P T F C T P G L | 22 |
| 39 | Y P M R I L Y D L | 21 |
| 367 | I P E D I L Q L L | 21 |
| 155 | S P Q L S D F G L | 20 |
| 185 | E P V I V T P P T | 20 |
| 283 | S P L V P T F C T | 20 |
| 296 | I P S T K N S I A | 19 |
| 103 | S P R V K K N S V | 18 |
| 291 | T P G L K I P S T | 18 |
| 152 | S P R S P Q L S D | 17 |
| 140 | D P P V A S S C I | 16 |
| 172 | L P N P P Q A V N | 16 |
| 190 | T P P T K Q S L V | 16 |
| 217 | T P K L E H F G I | 16 |
| 343 | D P S S P T I S S | 16 |
| 358 | T P T P P E V T K | 16 |

TABLE 26-continued

| Pos | | score |
|---|---|---|
| 392 | P P S K R F L K H | 16 |
| 150 | E K S P R S P Q L | 15 |
| 36 | F E D Y P M R I L | 14 |
| 191 | P P T K Q S L V K | 14 |
| 200 | V L K T P K C A L | 14 |
| 324 | V E D R T S L V L | 14 |
| 390 | A V P P S K R F L | 14 |
| 10 | K L R S L A S T L | 13 |
| 17 | T L D C E T A R L | 13 |
| 21 | E T A R L Q R A L | 13 |
| 74 | D F I K A T K V L | 13 |
| 224 | G I S E Y T M C L | 13 |
| 304 | A L V S T N Y P L | 13 |
| 364 | V T K I P E D I L | 13 |
| 366 | K I P E D I L Q L | 13 |
| 374 | L L S K Y N S N L | 13 |
| 384 | T P I A I K A V P | 13 |
| 3 | P I R S F C G K L | 12 |
| 6 | S F C G K L R S L | 12 |
| 115 | E A I N S D P E L | 12 |
| 164 | E R Y I V S Q V L | 12 |
| 193 | T K Q S L V K V L | 12 |
| 212 | D F E C V T P K L | 12 |
| 267 | S P I I Q Q L E K | 12 |
| 280 | Y T N S P L V P T | 12 |
| 288 | T F C T P G L K I | 12 |
| 297 | P S T K N S I A L | 12 |
| 322 | L E V E D R T S L | 12 |
| 333 | N S D T C F E N L | 12 |
| 348 | T I S S Y E N L L | 12 |
| 2 | D P I R S F C G K | 11 |
| 28 | A L D G E E S D F | 11 |
| 46 | D L H S E V Q T L | 11 |
| 53 | T L K D D V N I L | 11 |
| 54 | L K D D V N I L L | 11 |
| 59 | N I L L D K A R L | 11 |
| 141 | P P V A S S C I S | 11 |
| 174 | N P P Q A V N N Y | 11 |
| 175 | P P Q A V N N Y K | 11 |

TABLE 26-continued

| Pos | | score |
|---|---|---|
| 182 | Y K E E P V I V T | 11 |
| 189 | V T P P T K Q S L | 11 |
| 232 | L N E D Y T M G L | 11 |
| 250 | E A I D T E S R L | 11 |
| 262 | V F A T P S P I I | 11 |
| 277 | D A E Y T N S P L | 11 |
| 281 | T N S P L V P T F | 11 |
| 300 | K N S I A L V S T | 11 |
| 310 | Y P L S K T N S S | 11 |
| 314 | K T N S S S N D L | 11 |
| 357 | R T P T P P E V T | 11 |
| 360 | T P P E V T K I P | 11 |
| 361 | P P E V T K I P E | 11 |
| 389 | K A V P P S K R F | 11 |
| 391 | V P P S K R F L K | 11 |

(SEQ ID NOS 1669-1718, respectively, in order of appearance)
HLA-B*08 nonamers

| | 1 2 3 4 5 6 7 8 9 | |
|---|---|---|
| 200 | V L K T P K C A L | 28 |
| 53 | T L K D D V N I L | 27 |
| 103 | S P R V K K N S V | 25 |
| 217 | T P K L E H F G I | 23 |
| 6 | S F C G K L R S L | 22 |
| 10 | K L R S L A S T L | 22 |
| 364 | V T K I P E D I L | 21 |
| 3 | P I R S F C G K L | 20 |
| 8 | C G K L R S L A S | 20 |
| 81 | V L M E K N S M D | 20 |
| 150 | E K S P R S P Q L | 20 |
| 90 | I M K I R E Y F Q | 19 |
| 155 | S P Q L S D F G L | 19 |
| 62 | L D K A R L E N Q | 18 |
| 291 | T P G L K I P S T | 18 |
| 296 | I P S T K N S I A | 18 |
| 46 | D L H S E V Q T L | 17 |
| 60 | I L L D K A R L E | 17 |
| 115 | E A I N S D P E L | 17 |
| 203 | T P K C A L K M D | 17 |

TABLE 26-continued

| Pos | | score |
|---|---|---|
| 205 | K C A L K M D D F | 17 |
| 207 | A L K M D D F E C | 17 |
| 224 | G I S E Y T M C L | 17 |
| 239 | G L K N A R N N K | 17 |
| 265 | T P S P I I Q Q L | 17 |
| 286 | V P T F C T P G L | 17 |
| 293 | G L K I P S T K N | 17 |
| 304 | A L V S T N Y P L | 17 |
| 366 | K I P E D I L Q L | 17 |
| 367 | I P E D I L Q L L | 17 |
| 374 | L L S K Y N S N L | 17 |
| 391 | V P P S K R F L K | 17 |
| 397 | F L K H G Q N I R | 17 |
| 17 | T L D C E T A R L | 16 |
| 39 | Y P M R I L Y D L | 16 |
| 75 | F I K A T K V L M | 16 |
| 147 | C I S E K S P R S | 16 |
| 190 | T P P T K Q S L V | 16 |
| 215 | C V T P K L E H F | 16 |
| 250 | E A I D T E S R L | 16 |
| 277 | D A E Y T N S P L | 16 |
| 310 | Y P L S K T N S S | 16 |
| 373 | Q L L S K Y N S N | 16 |
| 59 | N I L L D K A R L | 15 |
| 255 | E S R L N D N V F | 15 |
| 385 | P I A I K A V P P | 15 |
| 152 | S P R S P Q L S D | 14 |
| 348 | T I S S Y E N L L | 14 |
| 387 | A I K A V P P S K | 14 |
| 392 | P P S K R F L K H | 14 |

(SEQ ID NOS 1719-1784, respectively, in order of appearance)
HLA-B*1510 nonamers 1 2 3 4 5 6 7 8 9

| 21 | E T A R L Q R A L | 15 |
| 150 | E K S P R S P Q L | 15 |
| 265 | T P S P I I Q Q L | 15 |
| 390 | A V P P S K R F L | 15 |
| 399 | K H G Q N I R D V | 15 |
| 36 | F E D Y P M R I L | 14 |

TABLE 26-continued

| Pos | | score |
|---|---|---|
| 193 | T K Q S L V K V L | 14 |
| 250 | E A I D T E S R L | 14 |
| 367 | I P E D I L Q L L | 14 |
| 6 | S F C G K L R S L | 13 |
| 17 | T L D C E T A R L | 13 |
| 53 | T L K D D V N I L | 13 |
| 59 | N I L L D K A R L | 13 |
| 74 | D F I K A T K V L | 13 |
| 115 | E A I N S D P E L | 13 |
| 164 | E R Y I V S Q V L | 13 |
| 189 | V T P P T K Q S L | 13 |
| 200 | V L K T P K C A L | 13 |
| 224 | G I S E Y T M C L | 13 |
| 281 | T N S P L V P T F | 13 |
| 297 | P S T K N S I A L | 13 |
| 46 | D L H S E V Q T L | 12 |
| 47 | L H S E V Q T L K | 12 |
| 111 | V H E Q E A I N S | 12 |
| 130 | Q K T D V K D D L | 12 |
| 212 | D F E C V T P K L | 12 |
| 221 | E H F G I S E Y T | 12 |
| 232 | L N E D Y T M G L | 12 |
| 322 | L E V E D R T S L | 12 |
| 324 | V E D R T S L V L | 12 |
| 348 | T I S S Y E N L L | 12 |
| 366 | K I P E D I L Q L | 12 |
| 374 | L L S K Y N S N L | 12 |
| 10 | K L R S L A S T L | 11 |
| 39 | Y P M R I L Y D L | 11 |
| 54 | L K D D V N I L L | 11 |
| 277 | D A E Y T N S P L | 11 |
| 286 | V P T F C T P G L | 11 |
| 364 | V T K I P E D I L | 11 |
| 389 | K A V P P S K R F | 11 |
| 3 | P I R S F C G K L | 10 |
| 155 | S P Q L S D F G L | 10 |
| 255 | E S R L N D N V F | 10 |
| 304 | A L V S T N Y P L | 10 |

TABLE 26-continued

| Pos | | | | | | | | | score |
|---|---|---|---|---|---|---|---|---|---|
| 314 | K | T | N | S | S | S | N | D | L | 10 |
| 333 | N | S | D | T | C | F | E | N | L | 10 |
| 347 | P | T | I | S | S | Y | E | N | L | 10 |
| 75 | F | I | K | A | T | K | V | L | M | 9 |
| 153 | P | R | S | P | Q | L | S | D | F | 9 |
| 89 | D | I | M | K | I | R | E | Y | F | 8 |
| 205 | K | C | A | L | K | M | D | D | F | 8 |
| 215 | C | V | T | P | K | L | E | H | F | 8 |
| 28 | A | L | D | G | E | E | S | D | F | 7 |
| 33 | E | S | D | F | E | D | Y | P | M | 7 |
| 67 | L | E | N | Q | E | G | I | D | F | 7 |
| 80 | K | V | L | M | E | K | N | S | M | 7 |
| 83 | M | E | K | N | S | M | D | I | M | 7 |
| 121 | P | E | L | S | N | C | E | N | F | 7 |
| 137 | D | L | S | D | P | P | V | A | S | 7 |
| 148 | I | S | E | K | S | P | R | S | P | 7 |
| 182 | Y | K | E | E | P | V | I | V | T | 7 |
| 183 | K | E | E | P | V | I | V | T | P | 7 |
| 202 | K | T | P | K | C | A | L | K | M | 7 |
| 222 | H | F | G | I | S | E | Y | T | M | 7 |
| 230 | M | C | L | N | E | D | Y | T | M | 7 |
| 358 | T | P | T | P | P | E | V | T | K | 7 |

(SEQ ID NOS 1785-1911, respectively, in order of appearance)
HLA-B*2705 nonamers

| | 1 | 2 | 3 | 4 | 5 | 6 | 7 | 8 | 9 | |
|---|---|---|---|---|---|---|---|---|---|---|
| 104 | P | R | V | K | K | N | S | V | H | 25 |
| 164 | E | R | Y | I | V | S | Q | V | L | 25 |
| 153 | P | R | S | P | Q | L | S | D | F | 23 |
| 65 | A | R | L | E | N | Q | E | G | I | 22 |
| 4 | I | R | S | F | C | G | K | L | R | 21 |
| 77 | K | A | T | K | V | L | M | E | K | 18 |
| 366 | K | I | P | E | D | I | L | Q | L | 18 |
| 389 | K | A | V | P | P | S | K | R | F | 18 |
| 395 | K | R | F | L | K | H | G | Q | N | 18 |
| 23 | A | R | L | Q | R | A | L | D | G | 17 |
| 59 | N | I | L | L | D | K | A | R | L | 17 |
| 72 | G | I | D | F | I | K | A | T | K | 17 |
| 127 | E | N | F | Q | K | T | D | V | K | 17 |
| 211 | D | D | F | E | C | V | T | P | K | 17 |

TABLE 26-continued

| Pos | | | | | | | | | | score |
|---|---|---|---|---|---|---|---|---|---|---|
| 292 | P | G | L | K | I | P | S | T | K | 17 |
| 370 | D | I | L | Q | L | L | S | K | Y | 17 |
| 10 | K | L | R | S | L | A | S | T | L | 16 |
| 47 | L | H | S | E | V | Q | T | L | K | 16 |
| 80 | K | V | L | M | E | K | N | S | M | 16 |
| 94 | R | E | Y | F | Q | K | Y | G | Y | 16 |
| 100 | Y | G | Y | S | P | R | V | K | K | 16 |
| 115 | E | A | I | N | S | D | P | E | L | 16 |
| 194 | K | Q | S | L | V | K | V | L | K | 16 |
| 202 | K | T | P | K | C | A | L | K | M | 16 |
| 239 | G | L | K | N | A | R | N | N | K | 16 |
| 265 | T | P | S | P | I | I | Q | Q | L | 16 |
| 267 | S | P | I | I | Q | Q | L | E | K | 16 |
| 330 | L | V | L | N | S | D | T | C | F | 16 |
| 369 | E | D | I | L | Q | L | L | S | K | 16 |
| 374 | L | L | S | K | Y | N | S | N | L | 16 |
| 396 | R | F | L | K | H | G | Q | N | I | 16 |
| 402 | Q | N | I | R | D | V | S | N | K | 16 |
| 6 | S | F | C | G | K | L | R | S | L | 15 |
| 28 | A | L | D | G | E | E | S | D | F | 15 |
| 34 | S | D | F | E | D | Y | P | M | R | 15 |
| 41 | M | R | I | L | Y | D | L | H | S | 15 |
| 58 | V | N | I | L | L | D | K | A | R | 15 |
| 74 | D | F | I | K | A | T | K | V | L | 15 |
| 88 | M | D | I | M | K | I | R | E | Y | 15 |
| 143 | V | A | S | S | C | I | S | E | K | 15 |
| 146 | S | C | I | S | E | K | S | P | R | 15 |
| 191 | P | P | T | K | Q | S | L | V | K | 15 |
| 220 | L | E | H | F | G | I | S | E | Y | 15 |
| 224 | G | I | S | E | Y | T | M | C | L | 15 |
| 236 | Y | T | M | G | L | K | N | A | R | 15 |
| 250 | E | A | I | D | T | E | S | R | L | 15 |
| 281 | T | N | S | P | L | V | P | T | F | 15 |
| 302 | S | I | A | L | V | S | T | N | Y | 15 |
| 314 | K | T | N | S | S | S | N | D | L | 15 |
| 322 | L | E | V | E | D | R | T | S | L | 15 |
| 326 | D | R | T | S | L | V | L | N | S | 15 |
| 347 | P | T | I | S | S | Y | E | N | L | 15 |

TABLE 26-continued

| Pos | | score |
|-----|---|-------|
| 381 | N L A T P I A I K | 15 |
| 388 | I K A V P P S K R | 15 |
| 397 | F L K H G Q N I R | 15 |
| 11  | L R S L A S T L D | 14 |
| 16  | S T L D C E T A R | 14 |
| 17  | T L D C E T A R L | 14 |
| 52  | Q T L K D D V N I | 14 |
| 56  | D D V N I L L D K | 14 |
| 67  | L E N Q E G I D F | 14 |
| 69  | N Q E G I D F I K | 14 |
| 85  | K N S M D I M K I | 14 |
| 91  | M K I R E Y F Q K | 14 |
| 99  | K Y G Y S P R V K | 14 |
| 121 | P E L S N C E N F | 14 |
| 150 | E K S P R S P Q L | 14 |
| 174 | N P P Q A V N N Y | 14 |
| 186 | P V I V T P P T K | 14 |
| 197 | L V K V L K T P K | 14 |
| 205 | K C A L K M D D F | 14 |
| 212 | D F E C V T P K L | 14 |
| 230 | M C L N E D Y T M | 14 |
| 243 | A R N N K S E E A | 14 |
| 255 | E S R L N D N V F | 14 |
| 256 | S R L N D N V F A | 14 |
| 272 | Q L E K S D A E Y | 14 |
| 297 | P S T K N S I A L | 14 |
| 304 | A L V S T N Y P L | 14 |
| 344 | P S S P T I S S Y | 14 |
| 349 | I S S Y E N L L R | 14 |
| 358 | T P T P P E V T K | 14 |
| 387 | A I K A V P P S K | 14 |
| 390 | A V P P S K R F L | 14 |
| 404 | I R D V S N K E N | 14 |
| 2   | D P I R S F C G K | 13 |
| 5   | R S F C G K L R S | 13 |
| 21  | E T A R L Q R A L | 13 |
| 39  | Y P M R I L Y D L | 13 |
| 46  | D L H S E V Q T L | 13 |
| 54  | L K D D V N I L L | 13 |

TABLE 26-continued

| Pos | | score |
|-----|---|-------|
| 89  | D I M K I R E Y F | 13 |
| 92  | K I R E Y F Q K Y | 13 |
| 93  | I R E Y F Q K Y G | 13 |
| 97  | F Q K Y G Y S P R | 13 |
| 123 | L S N C E N F Q K | 13 |
| 155 | S P Q L S D F G L | 13 |
| 158 | L S D F G L E R Y | 13 |
| 175 | P P Q A V N N Y K | 13 |
| 180 | N N Y K E E P V I | 13 |
| 189 | V T P P T K Q S L | 13 |
| 193 | T K Q S L V K V L | 13 |
| 201 | L K T P K C A L K | 13 |
| 214 | E C V T P K L E H | 13 |
| 215 | C V T P K L E H F | 13 |
| 244 | R N N K S E E A I | 13 |
| 287 | P T F C T P G L K | 13 |
| 319 | S N D L E V E D R | 13 |
| 324 | V E D R T S L V L | 13 |
| 356 | L R T P T P P E V | 13 |
| 359 | P T P P E V T K I | 13 |
| 367 | I P E D I L Q L L | 13 |
| 392 | P P S K R F L K H | 13 |
| 3   | P I R S F C G K L | 12 |
| 19  | D C E T A R L Q R | 12 |
| 26  | Q R A L D G E E S | 12 |
| 37  | E D Y P M R I L Y | 12 |
| 53  | T L K D D V N I L | 12 |
| 68  | E N Q E G I D F I | 12 |
| 84  | E K N S M D I M K | 12 |
| 130 | Q K T D V K D D L | 12 |
| 157 | Q L S D F G L E R | 12 |
| 159 | S D F G L E R Y I | 12 |
| 200 | V L K T P K C A L | 12 |
| 277 | D A E Y T N S P L | 12 |
| 306 | V S T N Y P L S K | 12 |
| 333 | N S D T C F E N L | 12 |

TABLE 26-continued (SEQ ID NOS 1912-1972, respectively, in order of appearance)
HLA-B*2709 nonamers

| Pos | 1 2 3 4 5 6 7 8 9 | score |
|---|---|---|
| 164 | E R Y I V S Q V L | 22 |
| 65 | A R L E N Q E G I | 21 |
| 356 | L R T P T P P E V | 21 |
| 153 | P R S P Q L S D F | 19 |
| 23 | A R L Q R A L D G | 15 |
| 326 | D R T S L V L N S | 15 |
| 366 | K I P E D I L Q L | 15 |
| 395 | K R F L K H G Q N | 15 |
| 396 | R F L K H G Q N I | 15 |
| 10 | K L R S L A S T L | 14 |
| 59 | N I L L D K A R L | 14 |
| 256 | S R L N D N V F A | 14 |
| 304 | A L V S T N Y P L | 14 |
| 52 | Q T L K D D V N I | 13 |
| 150 | E K S P R S P Q L | 13 |
| 224 | G I S E Y T M C L | 13 |
| 265 | T P S P I I Q Q L | 13 |
| 314 | K T N S S S N D L | 13 |
| 347 | P T I S S Y E N L | 13 |
| 389 | K A V P P S K R F | 13 |
| 39 | Y P M R I L Y D L | 12 |
| 41 | M R I L Y D L H S | 12 |
| 46 | D L H S E V Q T L | 12 |
| 53 | T L K D D V N I L | 12 |
| 73 | I D F I K A T K V | 12 |
| 80 | K V L M E K N S M | 12 |
| 98 | Q K Y G Y S P R V | 12 |
| 115 | E A I N S D P E L | 12 |
| 121 | P E L S N C E N F | 12 |
| 193 | T K Q S L V K V L | 12 |
| 202 | K T P K C A L K M | 12 |
| 244 | R N N K S E E A I | 12 |
| 250 | E A I D T E S R L | 12 |
| 278 | A E Y T N S P L V | 12 |
| 286 | V P T F C T P G L | 12 |
| 322 | L E V E D R T S L | 12 |

TABLE 26-continued

| Pos | | score |
|---|---|---|
| 367 | I P E D I L Q L L | 12 |
| 390 | A V P P S K R F L | 12 |
| 3 | P I R S F C G K L | 11 |
| 4 | I R S F C G K L R | 11 |
| 17 | T L D C E T A R L | 11 |
| 26 | Q R A L D G E E S | 11 |
| 43 | I L Y D L H S E V | 11 |
| 74 | D F I K A T K V L | 11 |
| 85 | K N S M D I M K I | 11 |
| 93 | I R E Y F Q K Y G | 11 |
| 104 | P R V K K N S V H | 11 |
| 130 | Q K T D V K D D L | 11 |
| 135 | K D D L S D P P V | 11 |
| 163 | L E R Y I V S Q V | 11 |
| 180 | N N Y K E E P V I | 11 |
| 189 | V T P P T K Q S L | 11 |
| 212 | D F E C V T P K L | 11 |
| 230 | M C L N E D Y T M | 11 |
| 243 | A R N N K S E E A | 11 |
| 281 | T N S P L V P T F | 11 |
| 295 | K I P S T K N S I | 11 |
| 297 | P S T K N S I A L | 11 |
| 324 | V E D R T S L V L | 11 |
| 333 | N S D T C F E N L | 11 |
| 348 | T I S S Y E N L L | 11 |

(SEQ ID NOS 1973-2055, respectively, in order of appearance)
HLA-B*5101

| Pos | 1 2 3 4 5 6 7 8 9 | score |
|---|---|---|
| 140 | D P P V A S S C I | 25 |
| 190 | T P P T K Q S L V | 22 |
| 277 | D A E Y T N S P L | 22 |
| 217 | T P K L E H F G I | 21 |
| 103 | S P R V K K N S V | 20 |
| 367 | I P E D I L Q L L | 20 |
| 39 | Y P M R I L Y D L | 19 |
| 180 | N N Y K E E P V I | 19 |
| 250 | E A I D T E S R L | 19 |
| 35 | D F E D Y P M R I | 18 |

TABLE 26-continued

| Pos | | score |
|---|---|---|
| 265 | T P S P I I Q Q L | 18 |
| 115 | E A I N S D P E L | 17 |
| 155 | S P Q L S D F G L | 17 |
| 286 | V P T F C T P G L | 17 |
| 360 | T P P E V T K I P | 17 |
| 2 | D P I R S F C G K | 16 |
| 73 | I D F I K A T K V | 16 |
| 120 | D P E L S N C E N | 16 |
| 303 | I A L V S T N Y P | 16 |
| 310 | Y P L S K T N S S | 16 |
| 359 | P T P P E V T K I | 16 |
| 380 | S N L A T P I A I | 16 |
| 382 | L A T F I A I K A | 16 |
| 43 | I L Y D L H S E V | 15 |
| 74 | D F I K A T K V L | 15 |
| 98 | Q K Y G Y S P R V | 15 |
| 100 | Y G Y S P R V K K | 15 |
| 161 | F G L E R Y I V S | 15 |
| 164 | E R Y I V S Q V L | 15 |
| 172 | L P N P P Q A V N | 15 |
| 174 | N P P Q A V N N Y | 15 |
| 175 | P P Q A V N N Y K | 15 |
| 191 | P P T K Q S L V K | 15 |
| 261 | N V F A T P S P I | 15 |
| 288 | T F C T P G L K I | 15 |
| 296 | T P S T K N S I A | 15 |
| 341 | L T D P S S P T I | 15 |
| 343 | D P S S P T I S S | 15 |
| 384 | T P I A I K A V P | 15 |
| 386 | I A I K A V P P S | 15 |
| 392 | P P S K R F L K H | 15 |
| 46 | D L H S E V Q T L | 14 |
| 52 | Q T L K D D V N I | 14 |
| 65 | A R L E N Q E G I | 14 |
| 77 | K A T K V L M E K | 14 |
| 206 | C A L K M D D F E | 14 |
| 212 | D F E C V T P K L | 14 |
| 263 | F A T P S P I I Q | 14 |
| 358 | T P T P P E V T K | 14 |

TABLE 26-continued

| Pos | | score |
|---|---|---|
| 378 | Y N S N L A T P I | 14 |
| 14 | L A S T L D C E T | 13 |
| 27 | R A L D G E E S D | 13 |
| 30 | D G E E S D F E D | 13 |
| 54 | L K D D V N I L L | 13 |
| 68 | E N Q E G I D E I | 13 |
| 82 | L M E K N S M D I | 13 |
| 85 | K N S M D I M K I | 13 |
| 159 | S D F G L E R Y I | 13 |
| 181 | N Y K E E P V I V | 13 |
| 192 | P T K Q S L V K V | 13 |
| 193 | T K Q S L V K V L | 13 |
| 203 | T P K C A L K M D | 13 |
| 278 | A E Y T N S P L V | 13 |
| 291 | T P G L K I P S T | 13 |
| 295 | K I P S T K N S I | 13 |
| 391 | V P P S K R F L K | 13 |
| 396 | R F L K H G Q N I | 13 |
| 141 | P P V A S S C I S | 12 |
| 143 | V A S S C I S E K | 12 |
| 160 | D F G L E R Y I V | 12 |
| 163 | L E R Y I V S Q V | 12 |
| 185 | E P V I V T P P T | 12 |
| 208 | L K M D D F E C V | 12 |
| 238 | M G L K N A R N N | 12 |
| 244 | R N N K S E E A I | 12 |
| 262 | V F A T P S P I I | 12 |
| 283 | S P L V P T F C T | 12 |
| 292 | P G L K I P S T K | 12 |
| 324 | V E D R T S L V L | 12 |
| 356 | L R T P T P P E V | 12 |
| 361 | P P E V T K I P E | 12 |
| 363 | E V T K I P E D I | 12 |
| 389 | K A V P P S K R F | 12 |

(SEQ ID NOS 2056-2162, respectively, in order of appearance)

HLA-A*0201 decamers

| | 1 2 3 4 5 6 7 8 9 0 | |
|---|---|---|
| 355 | L L R T P T P P E V | 25 |
| 366 | K I P E D I L Q L L | 25 |

TABLE 26-continued

| Pos | | score |
|---|---|---|
| 162 | G L E R Y I V S Q V | 24 |
| 231 | C L N E D Y T M G L | 24 |
| 81 | V L M E K N S M D I | 22 |
| 373 | Q L L S K Y N S N L | 22 |
| 16 | S T L D C E T A R L | 21 |
| 42 | R I L Y D L H S E V | 21 |
| 52 | Q T L K D D V N I L | 21 |
| 207 | A L K M D D F E C V | 21 |
| 340 | N L T D P S S P T I | 21 |
| 382 | L A T P I A I K A V | 21 |
| 13 | S L A S T L D C E T | 20 |
| 45 | Y D L H S E V Q T L | 20 |
| 53 | T L K D D V N I L L | 20 |
| 72 | G I D F I K A T K V | 20 |
| 264 | A T P S P I I Q Q L | 20 |
| 321 | D L E V E D R T S L | 20 |
| 170 | Q V L P N P P Q A V | 19 |
| 188 | I V T P P T K Q S L | 19 |
| 303 | I A L V S T N Y P L | 19 |
| 365 | T K I P E D I L Q L | 19 |
| 60 | I L L D K A R L E N | 18 |
| 137 | D L S D P P V A S S | 18 |
| 199 | K V L K T P K C A L | 18 |
| 285 | L V P T F C T P G L | 18 |
| 381 | N L A T P I A I K A | 18 |
| 398 | L K H G Q N I R D V | 18 |
| 5 | R S F C G K L R S L | 17 |
| 178 | A V N N Y K E E P V | 17 |
| 189 | V T P P T K Q S L V | 17 |
| 290 | C T P G L K I P S T | 17 |
| 294 | L K I P S T K N S I | 17 |
| 374 | L L S K Y N S N L A | 17 |
| 389 | K A V P P S K R F L | 17 |
| 61 | L L D K A R L E N Q | 16 |
| 87 | S M D I M K I R E Y | 16 |
| 159 | S D F G L E R Y I V | 16 |
| 219 | K L E H F G I S E Y | 16 |
| 257 | R L N D N V F A T P | 16 |

TABLE 26-continued

| Pos | | score |
|---|---|---|
| 276 | S D A E Y T N S P L | 16 |
| 9 | G K L R S L A S T L | 15 |
| 58 | V N I L L D K A R L | 15 |
| 67 | L E N Q E G I D F I | 15 |
| 102 | Y S P R V K K N S V | 15 |
| 114 | Q E A I N S D P E L | 15 |
| 157 | Q L S D F G L E R Y | 15 |
| 166 | Y I V S Q V L P N P | 15 |
| 211 | D D F E C V T P K L | 15 |
| 229 | T M C L N E D Y T M | 15 |
| 358 | T P T P P E V T K I | 15 |
| 28 | A L D G E E S D F E | 14 |
| 38 | D Y P M R I L Y D L | 14 |
| 43 | I L Y D L H S E V Q | 14 |
| 64 | K A R L E N Q E G I | 14 |
| 116 | A I N S D P E L S N | 14 |
| 191 | P P T K Q S L V K V | 14 |
| 209 | K M D D F E C V T P | 14 |
| 216 | V T P K L E H F G I | 14 |
| 261 | N V F A T P S P I I | 14 |
| 269 | I I Q Q L E K S D A | 14 |
| 280 | Y T N S P L V P T F | 14 |
| 322 | L E V E D R T S L V | 14 |
| 331 | V L N S D T C F E N | 14 |
| 347 | P T I S S Y E N L L | 14 |
| 2 | D P I R S F C G K L | 13 |
| 34 | S D F E D Y P M R I | 13 |
| 75 | F I K A T K V L M E | 13 |
| 82 | L M E K N S M D I M | 13 |
| 134 | V K D D L S D P P V | 13 |
| 161 | F G L E R Y I V S Q | 13 |
| 171 | V L P N P P Q A V N | 13 |
| 180 | N N Y K E E P V I V | 13 |
| 192 | P T K Q S L V K V L | 13 |
| 223 | F G I S E Y T M C L | 13 |
| 239 | G L K N A R N N K S | 13 |
| 256 | S R L N D N V F A T | 13 |
| 272 | Q L E K S D A E Y T | 13 |
| 287 | P T F C T P G L K I | 13 |

TABLE 26-continued

| Pos | | score |
|---|---|---|
| 295 | K I P S T K N S I A | 13 |
| 296 | I P S T K N S I A L | 13 |
| 299 | T K N S I A L V S T | 13 |
| 302 | S I A L V S T N Y P | 13 |
| 304 | A L V S T N Y P L S | 13 |
| 315 | T N S S S N D L E V | 13 |
| 332 | L N S D T C F E N L | 13 |
| 354 | N L L R T P T P P E | 13 |
| 371 | I L Q L L S K Y N S | 13 |
| 14 | L A S T L D C E T A | 12 |
| 24 | R L Q R A L D G E E | 12 |
| 49 | S E V Q T L K D D V | 12 |
| 73 | I D F I K A T K V L | 12 |
| 84 | E K N S M D I M K I | 12 |
| 139 | S D P P V A S S C I | 12 |
| 147 | C I S E K S P R S P | 12 |
| 149 | S E K S P R S P Q L | 12 |
| 194 | K Q S L V K V L K T | 12 |
| 196 | S L V K V L K T P K | 12 |
| 200 | V L K T P K C A L K | 12 |
| 243 | A R N N K S E E A I | 12 |
| 253 | D T E S R L N D N V | 12 |
| 277 | D A E Y T N S P L V | 12 |
| 297 | P S T K N S I A L V | 12 |
| 313 | S K T N S S S N D L | 12 |
| 323 | E V E D R T S L V L | 12 |
| 329 | S L V L N S D T C F | 12 |
| 385 | P I A I K A V P P S | 12 |

(SEQ ID NOS 2163-2213, respectively, in order of appearance)
HLA-A*0203 decamers

| | 1 2 3 4 5 6 7 8 9 0 | |
|---|---|---|
| 6 | S F C G K L R S L A | 10 |
| 14 | L A S T L D C E T A | 10 |
| 19 | D C E T A R L Q R A | 10 |
| 56 | D D V N I L L D K A | 10 |
| 69 | N Q E G I D F I K A | 10 |
| 107 | K K N S V H E Q E A | 10 |
| 135 | K D D L S D P P V A | 10 |
| 169 | S Q V L P N P P Q A | 10 |
| 198 | V K V L K T P K C A | 10 |
| 234 | E D Y T M G L K N A | 10 |
| 242 | N A R N N K S E E A | 10 |
| 255 | E S R L N D N V F A | 10 |
| 269 | I I Q Q L E K S D A | 10 |
| 295 | K I P S T K N S I A | 10 |
| 374 | L L S K Y N S N L A | 10 |
| 378 | Y N S N L A T P I A | 10 |
| 381 | N L A T P I A I K A | 10 |
| 7 | F C G K L R S L A S | 9 |
| 15 | A S T L D C E T A R | 9 |
| 20 | C E T A R L Q R A L | 9 |
| 57 | D V N I L L D K A R | 9 |
| 70 | Q E G I D F I K A T | 9 |
| 108 | K N S V H E Q E A I | 9 |
| 136 | D D L S D P P V A S | 9 |
| 170 | Q V L P N P P Q A V | 9 |
| 199 | K V L K T P K C A L | 9 |
| 235 | D Y T M G L K N A R | 9 |
| 243 | A R N N K S E E A I | 9 |
| 256 | S R L N D N V F A T | 9 |
| 270 | I Q Q L E K S D A E | 9 |
| 296 | I P S T K N S I A L | 9 |
| 375 | L S K Y N S N L A T | 9 |
| 379 | N S N L A T P I A I | 9 |
| 382 | L A T P I A I K A V | 9 |
| 8 | C G K L R S L A S T | 8 |
| 16 | S T L D C E T A R L | 8 |
| 21 | E T A R L Q R A L D | 8 |
| 58 | V N I L L D K A R L | 8 |
| 71 | E G I D F I K A T K | 8 |
| 109 | N S V H E Q E A I N | 8 |
| 137 | D L S D P P V A S S | 8 |
| 171 | V L P N P P Q A V N | 8 |
| 200 | V L K T P K C A L K | 8 |
| 236 | Y T M G L K N A R N | 8 |
| 244 | R N N K S E E A I D | 8 |
| 257 | R L N D N V F A T P | 8 |

TABLE 26-continued

| Pos | | score |
|---|---|---|
| 271 | Q Q L E K S D A E Y | 8 |
| 297 | P S T K N S I A L V | 8 |
| 376 | S K Y N S N L A T P | 8 |
| 380 | S N L A T P I A I K | 8 |
| 383 | A T P I A I K A V P | 8 |

(SEQ ID NOS 2214-2240, respectively, in order of appearance)
HLA-A1 decamers

| Pos | 1 2 3 4 5 6 7 8 9 0 | score |
|---|---|---|
| 36 | F E D Y P M R I L Y | 33 |
| 30 | D G E E S D F E D Y | 28 |
| 87 | S M D I M K I R E Y | 27 |
| 219 | K L E H F G I S E Y | 26 |
| 93 | I R E Y F Q K Y G Y | 25 |
| 131 | K T D V K D D L S D | 22 |
| 69 | N Q E G I D F I K A | 20 |
| 91 | M K I R E Y F Q K Y | 20 |
| 173 | P N P P Q A V N N Y | 20 |
| 225 | I S E Y T M C L N E | 20 |
| 341 | L T D P S S P T I S | 20 |
| 233 | N E D Y T M G L K N | 19 |
| 301 | N S I A L V S T N Y | 19 |
| 54 | L K D D V N I L L D | 18 |
| 118 | N S D P E L S N C E | 18 |
| 138 | L S D P P V A S S C | 18 |
| 251 | A I D T E S R L N D | 18 |
| 367 | I P E D I L Q L L S | 18 |
| 253 | D T E S R L N D N V | 17 |
| 323 | E V E D R T S L V L | 17 |
| 369 | E D I L Q L L S K Y | 17 |
| 55 | K D D V N I L L D K | 16 |
| 66 | R L E N Q E G I D F | 16 |
| 157 | Q L S D F G L E R Y | 16 |
| 227 | E Y T M C L N E D Y | 16 |
| 333 | N S D T C F E N L T | 16 |
| 368 | P E D I L Q L L S K | 16 |

TABLE 26-continued

| Pos | | score |
|---|---|---|

(SEQ ID NOS 2241-2330, respectively, in order of appearance)
HLA-A26 decamers

| Pos | 1 2 3 4 5 6 7 8 9 0 | score |
|---|---|---|
| 264 | A T P S P I I Q Q L | 26 |
| 280 | Y T N S P L V P T F | 26 |
| 366 | K I P E D I L Q L L | 26 |
| 35 | D F E D Y P M R I L | 25 |
| 323 | E V E D R T S L V L | 25 |
| 363 | E V T K I P E D I L | 25 |
| 74 | D F I K A T K V L M | 24 |
| 157 | Q L S D F G L E R Y | 24 |
| 192 | P T K Q S L V K V L | 24 |
| 219 | K L E H F G I S E Y | 24 |
| 369 | E D I L Q L L S K Y | 24 |
| 52 | Q T L K D D V N I L | 23 |
| 321 | D L E V E D R T S L | 23 |
| 343 | D P S S P T I S S Y | 23 |
| 30 | D G E E S D F E D Y | 22 |
| 188 | I V T P P T K Q S L | 22 |
| 16 | S T L D C E T A R L | 21 |
| 137 | D L S D P P V A S S | 21 |
| 214 | E C V T P K L E H F | 21 |
| 285 | L V P T F C T P G L | 21 |
| 347 | P T I S S Y E N L L | 21 |
| 199 | K V L K T P K C A L | 20 |
| 211 | D D F E C V T P K L | 20 |
| 231 | C L N E D Y T M G L | 20 |
| 335 | D T C F E N L T D P | 20 |
| 38 | D Y P M R I L Y D L | 19 |
| 290 | C T P G L K I P S T | 19 |
| 373 | Q L L S K Y N S N L | 19 |
| 21 | E T A R L Q R A L D | 18 |
| 53 | T L K D D V N I L L | 18 |
| 66 | R L E N Q E G I D F | 18 |
| 91 | M K I R E Y F Q K Y | 18 |
| 133 | D V K D D L S D P P | 18 |
| 142 | P V A S S C I S E K | 18 |
| 173 | P N P P Q A V N N Y | 18 |
| 221 | E H F G I S E Y T M | 18 |

TABLE 26-continued

| Pos | | score |
|---|---|---|
| 253 | D T E S R L N D N V | 18 |
| 329 | S L V L N S D T C F | 18 |
| 2 | D P I R S F C G K L | 17 |
| 57 | D V N I L L D K A R | 17 |
| 89 | D I M K I R E Y F Q | 17 |
| 105 | R V K K N S V H E Q | 17 |
| 120 | D P E L S N C E N F | 17 |
| 166 | Y I V S Q V L P N P | 17 |
| 202 | K T P K C A L K M D | 17 |
| 249 | E E A I D T E S R L | 17 |
| 365 | T K I P E D I L Q L | 17 |
| 370 | D I L Q L L S K Y N | 17 |
| 50 | E V Q T L K D D V N | 16 |
| 75 | F I K A T K V L M E | 16 |
| 87 | S M D I M K I R E Y | 16 |
| 152 | S P R S P Q L S D F | 16 |
| 160 | D F G L E R Y I V S | 16 |
| 224 | G I S E Y T M C L N | 16 |
| 227 | E Y T M C L N E D Y | 16 |
| 385 | P I A I K A V P P S | 16 |
| 5 | R S F C G K L R S L | 15 |
| 32 | E E S D F E D Y P M | 15 |
| 46 | D L H S E V Q T L K | 15 |
| 61 | L L D K A R L E N Q | 15 |
| 122 | E L S N C E N F Q K | 15 |
| 162 | G L E R Y I V S Q V | 14 |
| 170 | Q V L P N P P Q A V | 14 |
| 189 | V T P P T K Q S L V | 14 |
| 204 | P K C A L K M D D F | 14 |
| 236 | Y T M G L K N A R N | 14 |
| 257 | R L N D N V F A T P | 14 |
| 268 | P I I Q Q L E K S D | 14 |
| 271 | Q Q L E K S D A E Y | 14 |
| 304 | A L V S T N Y P L S | 14 |
| 332 | L N S D T C F E N L | 14 |
| 33 | E S D F E D Y P M R | 13 |
| 45 | Y D L H S E V Q T L | 13 |
| 82 | L M E K N S M D I M | 13 |

TABLE 26-continued

| Pos | | score |
|---|---|---|
| 84 | E K N S M D I M K I | 13 |
| 110 | S V H E Q E A I N S | 13 |
| 147 | C I S E K S P R S P | 13 |
| 186 | P V I V T P P T K Q | 13 |
| 197 | L V K V L K T P K C | 13 |
| 207 | A L K M D D F E C V | 13 |
| 216 | V T P K L E H F G I | 13 |
| 261 | N V F A T P S P I I | 13 |
| 287 | P T F C T P G L K I | 13 |
| 295 | K I P S T K N S I A | 13 |
| 301 | N S I A L V S T N Y | 13 |
| 341 | L T D P S S P T I S | 13 |
| 346 | S P T I S S Y E N L | 13 |
| 359 | P T P P E V T K I P | 13 |
| 387 | A I K A V P P S K R | 13 |
| 390 | A V P P S K R F L K | 13 |

(SEQ ID NOS 2331-2416, respectively, in order of appearance)
HLA-A3 decamers 1 2 3 4 5 6 7 8 9 0

| 390 | A V P P S K R F L K | 27 |
|---|---|---|
| 305 | L V S T N Y P L S K | 26 |
| 122 | E L S N C E N F Q K | 24 |
| 142 | P V A S S C I S E K | 24 |
| 200 | V L K T P K C A L K | 24 |
| 98 | Q K Y G Y S P R V K | 23 |
| 66 | R L E N Q E G I D F | 22 |
| 196 | S L V K V L K T P K | 22 |
| 219 | K L E H F G I S E Y | 22 |
| 257 | R L N D N V F A T P | 22 |
| 357 | R T P T P P E V T K | 22 |
| 387 | A I K A V P P S K R | 22 |
| 43 | I L Y D L H S E V Q | 21 |
| 46 | D L H S E V Q T L K | 21 |
| 71 | E G I D F I K A T K | 21 |
| 60 | I L L D K A R L E N | 19 |
| 80 | K V L M E K N S M D | 19 |
| 157 | Q L S D F G L E R Y | 19 |
| 162 | G L E R Y I V S Q V | 19 |
| 170 | Q V L P N P P Q A V | 19 |

TABLE 26-continued

| Pos | | score |
|---|---|---|
| 291 | T P G L K I P S T K | 19 |
| 3 | P I R S F C G K L R | 18 |
| 24 | R L Q R A L D G E E | 18 |
| 99 | K Y G Y S P R V K K | 18 |
| 171 | V L P N P P Q A V N | 18 |
| 323 | E V E D R T S L V L | 18 |
| 380 | S N L A T P I A I K | 18 |
| 386 | I A I K A V P P S K | 18 |
| 10 | K L R S L A S T L D | 17 |
| 42 | R I L Y D L H S E V | 17 |
| 90 | I M K I R E Y F Q K | 17 |
| 188 | I V T P P T K Q S L | 17 |
| 190 | T P P T K Q S L V K | 17 |
| 329 | S L V L N S D T C F | 17 |
| 373 | Q L L S K Y N S N L | 17 |
| 55 | K D D V N I L L D K | 16 |
| 57 | D V N I L L D K A R | 16 |
| 116 | A I N S D P E L S N | 16 |
| 137 | D L S D P P V A S S | 16 |
| 185 | E P V I V T P P T K | 16 |
| 199 | K V L K T P K C A L | 16 |
| 368 | P E D I L Q L L S K | 16 |
| 9 | G K L R S L A S T L | 15 |
| 28 | A L D G E E S D F E | 15 |
| 75 | F I K A T K V L M E | 15 |
| 92 | K I R E Y F Q K Y G | 15 |
| 103 | S P R V K K N S V H | 15 |
| 105 | R V K K N S V H E Q | 15 |
| 110 | S V H E Q E A I N S | 15 |
| 186 | P V I V T P P T K Q | 15 |
| 251 | A I D T E S R L N D | 15 |
| 272 | Q L E K S D A E Y T | 15 |
| 278 | A E Y T N S P L V P | 15 |
| 311 | P L S K T N S S S N | 15 |
| 340 | N L T D P S S P T I | 15 |
| 348 | T I S S Y E N L L R | 15 |
| 354 | N L L R T P T P P E | 15 |
| 27 | R A L D G E E S D F | 14 |
| 50 | E V Q T L K D D V N | 14 |
| 59 | N I L L D K A R L E | 14 |
| 76 | I K A T K V L M E K | 14 |
| 126 | C E N F Q K T D V K | 14 |
| 178 | A V N N Y K E E P V | 14 |
| 193 | T K Q S L V K V L K | 14 |
| 207 | A L K M D D F E C V | 14 |
| 266 | P S P I I Q Q L E K | 14 |
| 271 | Q Q L E K S D A E Y | 14 |
| 284 | P L V P T F C T P G | 14 |
| 295 | K I P S T K N S I A | 14 |
| 321 | D L E V E D R T S L | 14 |
| 355 | L L R T P T P P E V | 14 |
| 381 | N L A T P I A I K A | 14 |
| 401 | G Q N I R D V S N K | 14 |
| 17 | T L D C E T A R L Q | 13 |
| 83 | M E K N S M D I M K | 13 |
| 167 | I V S Q V L P N P P | 13 |
| 215 | C V T P K L E H F G | 13 |
| 238 | M G L K N A R N N K | 13 |
| 268 | P I I Q Q L E K S D | 13 |
| 269 | I I Q Q L E K S D A | 13 |
| 298 | S T K N S I A L V S | 13 |
| 304 | A L V S T N Y P L S | 13 |
| 330 | L V L N S D T C F E | 13 |
| 369 | E D I L Q L L S K Y | 13 |
| 371 | I L Q L L S K Y N S | 13 |
| 376 | S K Y N S N L A T P | 13 |

(SEQ ID NOS 2417-2456, respectively, in order of appearance)
HLA-B*0702 decamers 1 2 3 4 5 6 7 8 9 0

| Pos | | score |
|---|---|---|
| 296 | I P S T K N S I A L | 24 |
| 2 | D P I R S F C G K L | 20 |
| 346 | S P T I S S Y E N L | 20 |
| 191 | P P T K Q S L V K V | 19 |
| 358 | T P T P P E V T K I | 19 |
| 152 | S P R S P Q L S D F | 18 |
| 120 | D P E L S N C E N F | 16 |
| 323 | E V E D R T S L V L | 14 |

TABLE 26-continued

| Pos | | score |
|---|---|---|
| 384 | T P I A I K A V P P | 14 |
| 73 | I D F I K A T K V L | 13 |
| 103 | S P R V K K N S V H | 13 |
| 163 | L E R Y I V S Q V L | 13 |
| 172 | L P N P P Q A V N N | 13 |
| 190 | T P P T K Q S L V K | 13 |
| 199 | K V L K T P K C A L | 13 |
| 265 | T P S P I I Q Q L E | 13 |
| 332 | L N S D T C F E N L | 13 |
| 365 | T K I P E D I L Q L | 13 |
| 367 | I P E D I L Q L L S | 13 |
| 389 | K A V P P S K R F L | 13 |
| 391 | V P P S K R F L K H | 13 |
| 392 | P P S K R F L K H G | 13 |
| 16 | S T L D C E T A R L | 12 |
| 20 | C E T A R L Q R A L | 12 |
| 52 | Q T L K D D V N I L | 12 |
| 114 | Q E A I N S D P E L | 12 |
| 185 | E P V I V T P P T K | 12 |
| 188 | I V T P P T K Q S L | 12 |
| 192 | P T K Q S L V K V L | 12 |
| 194 | K Q S L V K V L K T | 12 |
| 211 | D D F E C V T P K L | 12 |
| 249 | E E A I D T E S R L | 12 |
| 255 | E S R L N D N V F A | 12 |
| 264 | A T P S P I I Q Q L | 12 |
| 276 | S D A E Y T N S P L | 12 |
| 285 | L V P T F C T P G L | 12 |
| 303 | I A L V S T N Y P L | 12 |
| 321 | D L E V E D R T S L | 12 |
| 343 | D P S S P T I S S Y | 12 |
| 363 | E V T K I P E D I L | 12 |

TABLE 26-continued

| Pos | | score |
|---|---|---|

MHC Class I nonamer analysis of amino acids 142-158 (pVASSCISGKSPRSPQL) (SEQ ID NO:1282) of 193P1E1b variant 2 that contains an E to G mutation at amino acid 150. Listed are those alleles and peptides in which the score falls within the top 50% (rounded up) of the scores from the analysis of the variant 1 base peptide sequence.
(SEQ ID NO:2457)
HLA-A*0201 nonamers

| | 1 2 3 4 5 6 7 8 9 | |
|---|---|---|
| 150 | G K S P R S P Q L | 14 |

(SEQ ID NO:2458)
HLA-B*0702 nonamers

| | 1 2 3 4 5 6 7 8 9 | |
|---|---|---|
| 150 | G K S P R S P Q L | 14 |

(SEQ ID NOS 2459-2460, respectively, in order of appearance)
HLA-B*08 nonamers

| | 1 2 3 4 5 6 7 8 9 | |
|---|---|---|
| 150 | G K S P R S P Q L | 19 |
| 147 | C I S G K S P R S | 14 |

(SEQ ID NO:2461)
HLA-B*1510 nonamers

| | 1 2 3 4 5 6 7 8 9 | |
|---|---|---|
| 150 | G K S P R S P Q L | 15 |

(SEQ ID NOS 2462-2464, respectively, in order of appearance)
HLA-B*2705 nonamers

| | 1 2 3 4 5 6 7 8 9 | |
|---|---|---|
| 150 | G K S P R S P Q L | 17 |
| 146 | S C I S G K S P R | 16 |
| 143 | V A S S C I S G K | 14 |

(SEQ ID NO:2465)
HLA-B*2709 nonamers

| | 1 2 3 4 5 6 7 8 9 | |
|---|---|---|
| 150 | G K S P R S P Q L | 16 |

(SEQ ID NO:2466)
HLA-B*5101 nonamers

| | 1 2 3 4 5 6 7 8 9 | |
|---|---|---|
| 143 | V A S S C I S G K | 12 |

TABLE 26-continued

| Pos | | score |
|---|---|---|

MHC Class I decamer analysis of amino acids 141-159 (PPVASSCISGKSPRSPQLS) (SEQ ID NO:1283) of 193P1E1b variant 2 that contains an E to G mutation at amino acid 150. Listed are those alleles and peptides in which the score falls within the top 50% (rounded up) of the scores from the analysis of the variant 1 base peptide sequence.
(SEQ ID NOS 2467-2468, respectively, in order of appearance)
HLA-A*0201 decamers

| | 1 2 3 4 5 6 7 8 9 0 | |
|---|---|---|
| 147 | C I S G K S P R S P | 12 |
| 149 | S G K S P R S P Q L | 12 |

(SEQ ID NOS 2469-2470, respectively, in order of appearance)
HLA-A26 decamers

| | 1 2 3 4 5 6 7 8 9 0 | |
|---|---|---|
| 142 | P V A S S C I S G K | 18 |
| 147 | C I S G K S P R S P | 13 |

(SEQ ID NOS 2471-2472, respectively, in order of appearance)
HLA-A3 decamers

| | 1 2 3 4 5 6 7 8 9 0 | |
|---|---|---|
| 142 | P V A S S C I S G K | 24 |
| 147 | C I S G K S P R S P | 13 |

MHC Class I nonamer analysis of amino acids 246-262 (NKSEEAIDAESRLNDNV) (SEQ ID NO:1284) of 193P1E1b variant 2 that contains a T to A mutation at amino acid 254. Listed are those alleles and peptides in which the score falls within the top 50% (rounded up) of the scores from the analysis of the variant 1 base peptide sequence.
(SEQ ID NOS 2473-2474, respectively, in order of appearance)
HLA-A*0201 nonamers

| | 1 2 3 4 5 6 7 8 9 | |
|---|---|---|
| 250 | E A I D A E S R L | 14 |
| 254 | A E S R L N D N V | 13 |

(SEQ ID NO:2475)
HLA-A*0203 nonamers

| | 1 2 3 4 5 6 7 8 9 | |
|---|---|---|
| 246 | N K S E E A I D A | 9 |

(SEQ ID NO:2476)
HLA-A26 nonamers

| | 1 2 3 4 5 6 7 8 9 | |
|---|---|---|
| 250 | E A I D A E S R L | 19 |

(SEQ ID NO:2477)
HLA-B*0702 nonamers

| | 1 2 3 4 5 6 7 8 9 | |
|---|---|---|
| 250 | E A I D A E S R L | 11 |

TABLE 26-continued

| Pos | | score |
|---|---|---|

(SEQ ID NO:2478)
HLA-B*08 nonamers

| | 1 2 3 4 5 6 7 8 9 | |
|---|---|---|
| 250 | E A I D A E S R L | 16 |

(SEQ ID NO:2479)
HLA-B*1510 nonamers

| | 1 2 3 4 5 6 7 8 9 | |
|---|---|---|
| 250 | E A I D A E S R L | 14 |

(SEQ ID NOS 2480-2481, respectively, in order of appearance)
HLA-B*2705

| | 1 2 3 4 5 6 7 8 9 | |
|---|---|---|
| 250 | E A I D A E S R L | 15 |
| 249 | E E A I D A E S R | 12 |

(SEQ ID NO:2482)
HLA-B*2709

| | 1 2 3 4 5 6 7 8 9 | |
|---|---|---|
| 250 | E A I D A E S R L | 12 |

(SEQ ID NOS 2483-2484, respectively, in order of appearance)
HLA-B*5101 nonamers

| | 1 2 3 4 5 6 7 8 9 | |
|---|---|---|
| 250 | E A I D A E S R L | 18 |
| 253 | D A E S R L N D N | 16 |

MHC Class I decamer analysis of amino acids 245-263 (NNKSEEAIDAESRLNDNVF) (SEQ ID NO:2485) of 193P1E1b variant 2 that contains a T to A mutation at amino acid 254. Listed are those alleles and peptides in which the score falls within the top 50% (rounded up) of the scores from the analysis of the variant 1 base peptide sequence.
(SEQ ID NO:2486)
HLA-A*0201 decamers

| | 1 2 3 4 5 6 7 8 9 0 | |
|---|---|---|
| 253 | D A E S R L N D N V | 12 |

(SEQ ID NOS 2487-2489, respectively, in order of appearance)
HLA-A*0203 decamers

| | 1 2 3 4 5 6 7 8 9 0 | |
|---|---|---|
| 245 | N N K S E E A I D A | 10 |
| 246 | N K S E E A I D A E | 9 |
| 3 | K S E E A T D A E S | 8 |

(SEQ ID NO:2490)
HLA-A1 decamers

| | 1 2 3 4 5 6 7 8 9 0 | |
|---|---|---|
| 251 | A I D A E S R L N D | 18 |

TABLE 26-continued

| Pos | | score |
|---|---|---|
| | (SEQ ID NO:2491) HLA-A26 decamers | |
| | 1 2 3 4 5 6 7 8 9 0 | |
| 249 | E E A I D A E S R L | 17 |
| | (SEQ ID NOS 2492-2493, respectively, in order of appearance) HLA-A3 decamers | |
| | 1 2 3 4 5 6 7 8 9 0 | |
| 251 | A I D A E S R L N D | 17 |
| 10 | A E S R L N D N V F | 14 |
| | (SEQ ID NO:2494) HLA-B*0702 decamers | |
| | 1 2 3 4 5 6 7 8 9 0 | |
| 249 | E E A I D A E S R L | 12 |

MHC Class I nonamer analysis of amino acids 366-373 and 374*-388* (KIPEDILQKFQWIYPTQKLNKMR) (SEQ ID NO:1236) of 193P1E1b variants 4 and 5 that delete amino acids 374-412 of variant 1 and encode new amino acids 374*-388* (underlined). Listed are those alleles and peptides in which the score falls within the top 50% (rounded up) of the scores from the analysis of the variant 1 base peptide sequence.
(SEQ ID NOS 2495-2499, respectively, in order of appearance)
HLA-A*0201 nonamers

| | 1 2 3 4 5 6 7 8 9 | |
|---|---|---|
| 370 | D I L Q K F Q W I | 18 |
| 366 | K I P E D I L Q K | 16 |
| 376* | Q W I Y P T Q K L | 16 |
| 371 | I L Q K F Q W I Y | 13 |
| 379* | Y P T Q K L N K M | 13 |
| | (SEQ ID NO:2500) HLA-A1 nonamers | |
| | 1 2 3 4 5 6 7 8 9 | |
| 371 | I L Q K F Q W I Y | 16 |
| | (SEQ ID NOS 2501-2504, respectively, in order of appearance) HLA-A26 nonamers | |
| | 1 2 3 4 5 6 7 8 9 | |
| 370 | D I L Q K F Q W I | 23 |
| 371 | I L Q K F Q W I Y | 19 |
| 366 | K I P E D I L Q K | 18 |
| 367 | I P E D I L Q K F | 17 |
| | (SEQ ID NOS 2505-2509, respectively, in order of appearance) HLA-A3 nonamers | |
| | 1 2 3 4 5 6 7 8 9 | |
| 366 | K I P E D I L Q K | 28 |

TABLE 26-continued

| Pos | | score |
|---|---|---|
| 371 | I L Q K F Q W I Y | 18 |
| 375* | F Q W I Y P T Q K | 16 |
| 377* | W I Y P T Q K L N | 15 |
| 378* | I Y P T Q K L N K | 15 |
| | (SEQ ID NOS 2510-2512, respectively, in order of appearance) HLA-B*0702 nonamers | |
| | 1 2 3 4 5 6 7 8 9 | |
| 367 | I P E D I L Q K F | 17 |
| 379* | Y P T Q K L N K M | 16 |
| 376* | Q W I Y P T Q K L | 14 |
| | (SEQ ID NOS 2513-2514, respectively, in order of appearance) HLA-B*08 nonamers | |
| | 1 2 3 4 5 6 7 8 9 | |
| 370 | D I L Q K F Q W I | 20 |
| 379* | Y P T Q K L N K M | 16 |
| | (SEQ ID NOS 2515-2517, respectively, in order of appearance) HLA-B*1510 nonamers | |
| | 1 2 3 4 5 6 7 8 9 | |
| 376* | Q W I Y P T Q K L | 11 |
| 367 | I P E D I L Q K F | 10 |
| 379* | Y P T Q K L N K M | 8 |
| | (SEQ ID NOS 2518-2525, respectively, in order of appearance) HLA-B*2705 nonamers | |
| | 1 2 3 4 5 6 7 8 9 | |
| 366 | K I P E D I L Q K | 18 |
| 367 | I P E D I L Q K F | 15 |
| 376* | Q W I Y P T Q K L | 15 |
| 378* | I Y P T Q K L N K | 15 |
| 379* | Y P T Q K L N K M | 15 |
| 371 | I L Q K F Q W I Y | 14 |
| 380 | P T Q K L N K M R | 14 |
| 375* | F Q W I Y P T Q K | 13 |
| | (SEQ ID NO:2526) HLA-B*2709 nonamers | |
| | 1 2 3 4 5 6 7 8 9 | |
| 376* | Q W I Y P T Q K L | 11 |

TABLE 26-continued

| Pos | | score |
|---|---|---|

(SEQ ID NOS 2527-2529, respectively, in order of appearance)
HLA-B*5101 nonamers

| | 1 2 3 4 5 6 7 8 9 | |
|---|---|---|
| 370 | D I L Q K F Q W I | 18 |
| 379* | Y P T Q K L N K M | 17 |
| 367 | I P E D I L Q K F | 16 |

MHC Class I decamer analysis of amino acids 365-373 and 374*-388* (TKIPEDILQKFQWIYPTQKLNKMR) (SEQ ID NO:1287) of 193P1E1b variants 4 and 5 that delete amino acids 374-412 of variant 1 and encode new amino acids 374*-388* underlined). Listed are those alleles and peptides in which the score falls within the top 50% (rounded up) of the scores from the analysis of the variant 1 base peptide sequence.
(SEQ ID NOS 2530-2534, respectively, in order of appearance)
HLA-A*0201 decamers

| | 1 2 3 4 5 6 7 8 9 0 | |
|---|---|---|
| 366 | K I P E D I̲ L Q K F | 17 |
| 375* | F Q W I Y P̲ T Q K L | 14 |
| 378* | I Y P T Q K̲ L N K M | 13 |
| 371 | I L Q K F Q̲ W I Y P | 12 |
| 377* | W I Y P T Q̲ K L N K | 12 |

(SEQ ID NOS 2535-2539, respectively, in order of appearance)
HLA-A26 decamers

| | 1 2 3 4 5 6 7 8 9 0 | |
|---|---|---|
| 366 | K I P E D I L Q K F | 29 |
| 370 | D I L Q K F Q W I Y | 27 |
| 378* | I Y P T Q K L N K M | 14 |
| 369 | E D I L Q K F Q W I | 13 |
| 377* | W I Y P T Q K L N K | 13 |

(SEQ ID NOS 2540-2544, respectively, in order of appearance)
HLA-A3 decamers

| | 1 2 3 4 5 6 7 8 9 0 | |
|---|---|---|
| 377* | W I Y P T Q̲ K L N K | 28 |
| 365 | T K I̲ P E D I̲ L Q K | 22 |
| 374* | K F Q W I Y P̲ T Q K | 18 |
| 366 | K I P̲ E D I̲ L Q K F | 16 |
| 370 | D I L̲ Q K F̲ Q W I Y | 16 |

(SEQ ID NO:2545)
HLA-B*0702 decamers

| | 1 2 3 4 5 6 7 8 9 0 | |
|---|---|---|
| 367 | I P E D I L Q K F Q | 12 |

TABLE 26-continued

| Pos | | score |
|---|---|---|

MHC Class I nonamer analysis of amino acids 27-34 and 374-381 of 193P1E1b variant 6 (RALDGEESLLSKYNSN) (SEQ ID NO:1288). Listed are those alleles and peptides in which the score falls within the top 50% (rounded up) of the scores from the analysis of variant 1 base peptide sequence.
(SEQ ID NOS 2546-2548, respectively, in order of appearance)
HLA-A*0201 nonamers

| | 1 2 3 4 5 6 7 8 9 | |
|---|---|---|
| 28 | A L D G E E̲ S L L | 24 |
| 27 | R A L D G E E S L | 21 |
| 34 | S L L S K Y̲ N S N | 18 |

(SEQ ID NOS 2549-2551, respectively. in order of appearance)
HLA-A1 nonamers

| | 1 2 3 4 5 6 7 8 9 | |
|---|---|---|
| 31 | G E̲ E S L L S̲ K Y | 27 |
| 30 | D G̲ E E S L L̲ S K | 16 |
| 28 | A L̲ D G E E̲ S L L | 15 |

(SEQ ID NOS 2552-2553, respectively, in order of appearance)
HLA-A26 nonamers

| | 1 2 3 4 5 6 7 8 9 | |
|---|---|---|
| 28 | A L D G E E S L L | 20 |
| 31 | G E E S L L S K Y | 18 |

(SEQ ID NOS 2554-2556, respectively, in order of appearance)
HLA-A3 nonamers

| | 1 2 3 4 5 6 7 8 9 | |
|---|---|---|
| 28 | A L D̲ G E E̲ S̲ L L | 18 |
| 30 | D G̲ E̲ E S L̲ L̲ S K | 16 |
| 34 | S L̲ L S K Y̲ N S N | 16 |

(SEQ ID NOS 2557-2558, respectively, in order of appearance)
HLA-B*0702 nonamers

| | 1 2 3 4 5 6 7 8 9 | |
|---|---|---|
| 28 | A L D G E E S L L | 15 |
| 27 | R A L D G E E S L | 11 |

(SEQ ID NOS 2559-2561, respectively, in order of appearance)
HLA-B*08 nonamers

| | 1 2 3 4 5 6 7 8 9 | |
|---|---|---|
| 34 | S L L S K Y N S N | 18 |
| 28 | A L D G E E S L L | 16 |
| 27 | R A L D G E E S L | 14 |

TABLE 26-continued

| Pos | | score |
|---|---|---|
| (SEQ ID NOS 2562-2563, respectively, in order of appearance) HLA-B*1510 nonamers | | |
| | 1 2 3 4 5 6 7 8 9 | |
| 27 | R A L D G E E S L | 12 |
| 28 | A L D G E E S L L | 11 |
| (SEQ ID NOS 2564-2567, respectively, in order of appearance) HLA-B*2705 nonamers | | |
| | 1 2 3 4 5 6 7 8 9 | |
| 27 | R A L D G E E S L | 19 |
| 31 | G E E S L L S K Y | 16 |
| 28 | A L D G E E S L L | 15 |
| 30 | D G E E S L L S K | 15 |
| (SEQ ID NOS 2568-2569, respectively, in order of appearance) HLA-B*2709 nonamers | | |
| | 1 2 3 4 5 6 7 8 9 | |
| 27 | R A L D G E E S L | 16 |
| 28 | A L D G E E S L L | 11 |
| (SEQ ID NOS 2570-2571, respectively, in order of appearance) HLA-B*5101 nonamers | | |
| | 1 2 3 4 5 6 7 8 9 | |
| 27 | R A L D G E E S L | 19 |
| 30 | D G E E S L L S K | 15 |

MHC Class I decamer analysis of amino acids 26-34 and 374-382 of 193P1E1b variant 6 (RALDGEESLLSKYNSN) (SEQ ID NO:1288). Listed are those alleles and peptides in which the score falls within the top 50% (rounded up) of the scores from the analysis of variant 1 base peptide sequence.
(SEQ ID NOS 2572-2575, respectively, in order of appearance)
HLA-A*0201 decamers

| Pos | | score |
|---|---|---|
| | 1 2 3 4 5 6 7 8 9 0 | |
| 34 | S L L S K Y N S N L | 24 |
| 27 | R A L D G E E S L L | 17 |
| 28 | A L D G E E S L L S | 15 |
| 26 | Q R A L D G E E S L | 14 |
| (SEQ ID NOS 2576-2578, respectively, in order of appearance) HLA-A1 decamers | | |
| 30 | D G E E S L L S K Y | 27 |
| 28 | A L D G E E S L L S | 21 |
| 31 | G E E S L L S K Y N | 10 |

TABLE 26-continued

| Pos | | score |
|---|---|---|
| (SEQ ID NOS 2579-2580, respectively, in order of appearance) HLA-A26 decamers | | |
| | 1 2 3 4 5 6 7 8 9 0 | |
| 5 | D G E E S L L S K Y | 24 |
| 9 | S L L S K Y N S N L | 19 |
| (SEQ ID NOS 2581-2583, respectively, in order of appearance) HLA-A3 decamers | | |
| | 1 2 3 4 5 6 7 8 9 0 | |
| 28 | A L D G E E S L L S | 18 |
| 29 | L D G E E S L L S K | 16 |
| 34 | S L L S K Y N S N L | 16 |

TABLE 27

| Pos | 1 2 3 4 5 6 7 8 9 0 1 2 3 4 5 | score |
|---|---|---|

MHC Class II 15-mer analysis of 193P1E1b variant 1 base peptide for selected alleles. Listed are scores that fall within the top 50% (rounded up) of all scores for the selected allele.
(SEQ ID NOS 2584-2702, respectively, in order of appearance)
HLA-DRB1*0101 15-mers

| Pos | Sequence | score |
|---|---|---|
| 70 | Q E G I D F I K A T K V L M E | 33 |
| 64 | K A R L E N Q E G I D F I K A | 31 |
| 108 | K N S V H E Q E A I N S D P E | 31 |
| 38 | D Y P M R I L Y D L H S E V Q | 29 |
| 300 | K N S I A L V S T N Y P L S K | 29 |
| 165 | R Y I V S Q V L P N P P Q A V | 28 |
| 375 | L S K Y N S N L A T P I A I K | 28 |
| 291 | T P G L K I P S T K N S I A L | 27 |
| 23 | A R L Q R A L D G E E S D F E | 26 |
| 93 | I R E Y F Q K Y G Y S P R V K | 26 |
| 335 | D T C F E N L T D P S S P T I | 26 |
| 8 | C G K L R S L A S T L D C E T | 25 |
| 229 | T M C L N E D Y T M G L K N A | 25 |
| 267 | S P I I Q Q L E K S D A E Y T | 25 |
| 307 | S T N Y P L S K T N S S S N D | 25 |
| 361 | P P E V T K I P E D I L Q L L | 25 |
| 369 | E D I L Q L L S K Y N S N L A | 25 |
| 379 | N S N L A T P I A I K A V P P | 25 |
| 5 | R S F C G K L R S L A S T L D | 24 |
| 185 | E P V I V T P P T K Q S L V K | 24 |

TABLE 27-continued

| Pos | 1 2 3 4 5 6 7 8 9 0 1 2 3 4 5 | score |
|---|---|---|
| 195 | Q S L V K V L K T P K C A L K | 24 |
| 283 | S P L V P T F C T P G L K I P | 24 |
| 350 | S S Y E N L L R T P T P P E V | 24 |
| 353 | E N L L R T P T P P E V T K I | 24 |
| 372 | L Q L L S K Y N S N L A T P I | 24 |
| 131 | K T D V K D D L S D P P V A S | 23 |
| 145 | S S C I S E K S P R S P Q L S | 23 |
| 164 | E R Y I V S Q V L P N P P Q A | 23 |
| 210 | M D D F E C V T P K L E H F G | 23 |
| 256 | S R L N D N V F A T P S P I I | 23 |
| 338 | F E N L T D P S S P T I S S Y | 23 |
| 368 | P E D I L Q L L S K Y N S N L | 23 |
| 41 | M R I L Y D L H S E V Q T L K | 22 |
| 79 | T K V L M E K N S M D I M K I | 22 |
| 161 | F G L E R Y I V S Q V L P N P | 22 |
| 168 | V S Q V L P N P P Q A V N N Y | 22 |
| 259 | N D N V F A T P S P I I Q Q L | 22 |
| 321 | D L E V E D R T S L V L N S D | 22 |
| 376 | S K Y N S N L A T P I A I K A | 22 |
| 382 | L A T P I A I K A V P P S K R | 22 |
| 385 | P I A I K A V P P S K R F L K | 22 |
| 55 | K D D V N I L L D K A R L E N | 21 |
| 214 | E C V T P K L E H F G I S E Y | 21 |
| 72 | G I D F I K A T K V L M E K N | 20 |
| 137 | D L S D P P V A S S C I S E K | 20 |
| 286 | V P T F C T P G L K I P S T K | 20 |
| 1 | M D P I R S F C G K L R S L A | 19 |
| 33 | E S D F E D Y P M R I L Y D L | 19 |
| 36 | F E D Y P M R I L Y D L H S E | 19 |
| 99 | K Y G Y S P R V K K N S V H E | 19 |
| 158 | L S D F G L E R Y I V S Q V L | 19 |
| 327 | R T S L V L N S D T C F E N L | 19 |
| 349 | I S S Y E N L L R T P T P P E | 19 |
| 383 | A T P I A I K A V P P S K R F | 19 |
| 4 | I R S F C G K L R S L A S T L | 18 |
| 57 | D V N I L L D K A R L E N Q E | 18 |
| 71 | E G I D F I K A T K V L M E K | 18 |
| 76 | I K A T K V L M E K N S M D I | 18 |
| 80 | K V L M E K N S M D I M K I R | 18 |

TABLE 27-continued

| Pos | 1 2 3 4 5 6 7 8 9 0 1 2 3 4 5 | score |
|---|---|---|
| 85 | K N S M D I M K I R E Y F Q K | 18 |
| 152 | S P R S P Q L S D F G L E R Y | 18 |
| 189 | V T P P T K Q S L V K V L K T | 18 |
| 194 | K Q S L V K V L K T P K C A L | 18 |
| 197 | L V K V L K T P K C A L K M D | 18 |
| 199 | K V L K T P K C A L K M D D F | 18 |
| 205 | K C A L K M D D F E C V T P K | 18 |
| 227 | E Y T M C L N E D Y T M G L K | 18 |
| 235 | D Y T M G L K N A R N N K S E | 18 |
| 237 | T M G L K N A R N N K S E E A | 18 |
| 265 | T P S P I I Q Q L E K S D A E | 18 |
| 270 | I Q Q L E K S D A E Y T N S P | 18 |
| 15 | A S T L D C E T A R L Q R A L | 17 |
| 20 | C E T A R L Q R A L D G E E S | 17 |
| 51 | V Q T L K D D V N I L L D K A | 17 |
| 56 | D D V N I L L D K A R L E N Q | 17 |
| 77 | K A T K V L M E K N S M D I M | 17 |
| 157 | Q L S D F G L E R Y I V S Q V | 17 |
| 162 | G L E R Y I V S Q V L P N P P | 17 |
| 176 | P Q A V N N Y K E E P V I V T | 17 |
| 178 | A V N N Y K E E P V I V T P P | 17 |
| 186 | P V I V T P P T K Q S L V K V | 17 |
| 196 | S L V K V L K T P K C A L K M | 17 |
| 207 | A L K M D D F E C V T P K L E | 17 |
| 255 | E S R L N D N V F A T P S P I | 17 |
| 285 | L V P T F C T P G L K I P S T | 17 |
| 296 | I P S T K N S I A L V S T N Y | 17 |
| 302 | S I A L V S T N Y P L S K T N | 17 |
| 306 | V S T N Y P L S K T N S S S N | 17 |
| 319 | S N D L E V E D R T S L V L N | 17 |
| 393 | P S K R F L K H G Q N I R D V | 17 |
| 7 | F C G K L R S L A S T L D C E | 16 |
| 12 | R S L A S T L D C E T A R L Q | 16 |
| 40 | P M R I L Y D L H S E V Q T L | 16 |
| 48 | H S E V Q T L K D D V N I L L | 16 |
| 54 | L K D D V N I L L D K A R L E | 16 |
| 82 | L M E K N S M D I M K I R E Y | 16 |
| 87 | S M D I M K I R E Y F Q K Y G | 16 |

TABLE 27-continued

| Pos | 1 2 3 4 5 6 7 8 9 0 1 2 3 4 5 | score |
|---|---|---|
| 132 | T D V K D D L S D P P V A S S | 16 |
| 135 | K D D L S D P P V A S S C I S | 16 |
| 160 | D F G L E R Y I V S Q V L P N | 16 |
| 167 | I V S Q V L P N P P Q A V N N | 16 |
| 183 | K E E P V I V T P P T K Q S L | 16 |
| 184 | E E P V I V T P P T K Q S L V | 16 |
| 202 | K T P K C A L K M D D F E C V | 16 |
| 232 | L N E D Y T M G L K N A R N N | 16 |
| 240 | L K N A R N N K S E E A I D T | 16 |
| 252 | I D T E S R L N D N V F A T P | 16 |
| 258 | L N D N V F A T P S P I I Q Q | 16 |
| 260 | D N V F A T P S P I I Q Q L E | 16 |
| 290 | C T P G L K I P S T K N S I A | 16 |
| 293 | G L K I P S T K N S I A L V S | 16 |
| 309 | N Y P L S K T N S S S N D L E | 16 |
| 318 | S S N D L E V E D R T S L V L | 16 |
| 336 | T C F E N L T D P S S P T I S | 16 |
| 351 | S Y E N L L R T P T P P E V T | 16 |
| 364 | V T K I P E D I L Q L L S K Y | 16 |
| 371 | I L Q L L S K Y N S N L A T P | 16 |
| 377 | K Y N S N L A T P I A I K A V | 16 |
| 380 | S N L A T P I A I K A V P P S | 16 |

(SEQ ID NOS 2703-2746, respectively, in order of appearance)
HLA-DRB1*0301 (DR17) 15-mers

| Pos | 1 2 3 4 5 6 7 8 9 0 1 2 3 4 5 | score |
|---|---|---|
| 51 | V Q T L K D D V N I L L D K A | 36 |
| 364 | V T K I P E D I L Q L L S K Y | 31 |
| 114 | Q E A I N S D P E L S N C E N | 29 |
| 229 | T M C L N E D Y T M G L K N A | 29 |
| 197 | L V K V L K T P K C A L K M D | 28 |
| 371 | I L Q L L S K Y N S N L A T P | 28 |
| 186 | P V I V T P P T K Q S L V K V | 27 |
| 361 | P P E V T K I P E D I L Q L L | 26 |
| 57 | D V N I L L D K A R L E N Q E | 25 |
| 127 | E N F Q K T D V K D D L S D P | 25 |
| 247 | K S E E A I D T E S R L N D N | 24 |
| 319 | S N D L E V E D R T S L V L N | 24 |
| 40 | P M R I L Y D L H S E V Q T L | 23 |
| 131 | K T D V K D D L S D P P V A S | 22 |
| 205 | K C A L K M D D F E C V T P K | 22 |

TABLE 27-continued

| Pos | 1 2 3 4 5 6 7 8 9 0 1 2 3 4 5 | score |
|---|---|---|
| 50 | E V Q T L K D D V N I L L D K | 21 |
| 327 | R T S L V L N S D T C F E N L | 21 |
| 329 | S L V L N S D T C F E N L T D | 21 |
| 78 | A T K V L M E K N S M D I M K | 20 |
| 346 | S P T I S S Y E N L L R T P T | 20 |
| 13 | S L A S T L D C E T A R L Q R | 19 |
| 58 | V N I L L D K A R L E N Q E G | 19 |
| 64 | K A R L E N Q E G I D F I K A | 19 |
| 85 | K N S M D I M K I R E Y F Q K | 19 |
| 155 | S P Q L S D F G L E R Y I V S | 19 |
| 213 | F E C V T P K L E H F G I S E | 19 |
| 217 | T P K L E H F G I S E Y T M C | 19 |
| 237 | T M G L K N A R N N K S E E A | 19 |
| 249 | E E A I D T E S R L N D N V F | 19 |
| 321 | D L E V E D R T S L V L N S D | 19 |
| 369 | E D I L Q L L S K Y N S N L A | 19 |
| 388 | I K A V P P S K R F L K H G Q | 19 |
| 24 | R L Q R A L D G E E S D F E D | 18 |
| 44 | L Y D L H S E V Q T L K D D V | 18 |
| 90 | I M K I R E Y F Q K Y G Y S P | 18 |
| 169 | S Q V L P N P P Q A V N N Y K | 18 |
| 194 | K Q S L V K V L K T P K C A L | 18 |
| 266 | P S P I I Q Q L E K S D A E Y | 18 |
| 271 | Q Q L E K S D A E Y T N S P L | 18 |
| 283 | S P L V P T F C T P G L K I P | 18 |
| 293 | G L K I P S T K N S I A L V S | 18 |
| 315 | T N S S S N D L E V E D R T S | 18 |
| 345 | S S P T I S S Y E N L L R T P | 18 |
| 394 | S K R F L K H G Q N I R D V S | 18 |

(SEQ ID NOS 2747-2865, respectively, in order of appearance)
HLA-DRB1*0401 (DR4Dw4) 15-mers

| Pos | 1 2 3 4 5 6 7 8 9 0 1 2 3 4 5 | score |
|---|---|---|
| 349 | I S S Y E N L L R T P T P P E | 28 |
| 40 | P M R I L Y D L H S E V Q T L | 26 |
| 41 | M R I L Y D L H S E V Q T L K | 26 |
| 44 | L Y D L H S E V Q T L K D D V | 26 |
| 51 | V Q T L K D D V N I L L D K A | 26 |
| 229 | T M C L N E D Y T M G L K N A | 26 |
| 237 | T M G L K N A R N N K S E E A | 26 |

TABLE 27-continued

| Pos | 1 2 3 4 5 6 7 8 9 0 1 2 3 4 5 | score |
|---|---|---|
| 283 | S P L V P T F C T P G L K I P | 26 |
| 319 | S N D L E V E D R T S L V L N | 26 |
| 368 | P E D I L Q L L S K Y N S N L | 26 |
| 72 | G I D F I K A T K V L M E K N | 22 |
| 97 | F Q K Y G Y S P R V K K N S V | 22 |
| 158 | L S D F G L E R Y I V S Q V L | 22 |
| 179 | V N N Y K E E P V I V T P P T | 22 |
| 307 | S T N Y P L S K T N S S S N D | 22 |
| 335 | D T C F E N L T D P S S P T I | 22 |
| 8 | C G K L R S L A S T L D C E T | 20 |
| 15 | A S T L D C E T A R L Q R A L | 20 |
| 26 | Q R A L D G E E S D F E D Y P | 20 |
| 38 | D Y P M R I L Y D L H S E V Q | 20 |
| 48 | H S E V Q T L K D D V N T L L | 20 |
| 59 | N I L L D K A R L E N Q E G I | 20 |
| 70 | Q E G I D F I K A T K V L M E | 20 |
| 78 | A T K V L M E K N S M D I M K | 20 |
| 87 | S M D I M K I R E Y F Q K Y G | 20 |
| 114 | Q E A I N S D P E L S N C E N | 20 |
| 120 | D P E L S N C E N F Q K T D V | 20 |
| 131 | K T D V K D D L S D P P V A S | 20 |
| 169 | S Q V L P N P P Q A V N N Y K | 20 |
| 185 | E P V I V T P P T K Q S L V K | 20 |
| 194 | K Q S L V K V L K T P K C A L | 20 |
| 195 | Q S L V K V L K T P K C A L K | 20 |
| 205 | K C A L K M D D F E C V T P K | 20 |
| 249 | E E A I D T E S R L N D N V F | 20 |
| 259 | N D N V F A T P S P I I Q Q L | 20 |
| 267 | S P I I Q Q L E K S D A E Y T | 20 |
| 291 | T P G L K I P S T K N S I A L | 20 |
| 293 | G L K I P S T K N S I A L V S | 20 |
| 300 | K N S I A L V S T N Y P L S K | 20 |
| 309 | N Y P L S K T N S S S N D L E | 20 |
| 329 | S L V L N S D T C F E N L T D | 20 |
| 338 | F E N L T D P S S P T I S S Y | 20 |
| 361 | P P E V T K I P E D T L Q L L | 20 |
| 364 | V T K I P E D I L Q L L S K Y | 20 |
| 369 | E D I L Q L L S K Y N S N L A | 20 |
| 372 | L Q L L S K Y N S N L A T P I | 20 |

TABLE 27-continued

| Pos | 1 2 3 4 5 6 7 8 9 0 1 2 3 4 5 | score |
|---|---|---|
| 388 | I K A V P P S K R F L K H G Q | 20 |
| 5 | R S F C G K L R S L A S T L D | 18 |
| 62 | L D K A R L E N Q E G I D F I | 18 |
| 117 | I N S D P E L S N C E N F Q K | 18 |
| 137 | D L S D P P V A S S C I S E K | 18 |
| 138 | L S D P P V A S S C I S E K S | 18 |
| 144 | A S S C I S E K S P R S P Q L | 18 |
| 157 | Q L S D F G L E R Y I V S Q V | 18 |
| 161 | F G L E R Y I V S Q V L P N P | 18 |
| 166 | Y I V S Q V L P N P P Q A V N | 18 |
| 172 | L P N P P Q A V N N Y K E E P | 18 |
| 182 | Y K E E P V I V T P P T K Q S | 18 |
| 214 | E C V T P K L E H F G I S E Y | 18 |
| 221 | E H F G I S E Y T M C L N E D | 18 |
| 234 | E D Y T M G L K N A R N N K S | 18 |
| 264 | A T P S P I I Q Q L E K S D A | 18 |
| 280 | Y T N S P L V P T F C T P G L | 18 |
| 290 | C T P G L K I P S T K N S I A | 18 |
| 320 | N D L E V E D R T S L V L N S | 18 |
| 325 | E D R T S L V L N S D T C F E | 18 |
| 337 | C F E N L T D P S S P T I S S | 18 |
| 343 | D P S S P T I S S Y E N L L R | 18 |
| 365 | T K I P E D I L Q L L S K Y N | 18 |
| 376 | S K Y N S N L A T P I A I K A | 18 |
| 392 | P P S K R F L K H G Q N I R D | 18 |
| 4 | I R S F C G K L R S L A S T L | 17 |
| 33 | E S D F E D Y P M R I L Y D L | 16 |
| 42 | R I L Y D L H S E V Q T L K D | 16 |
| 163 | L E R Y I V S Q V L P N P P Q | 16 |
| 210 | M D D F E C V T P K L E H F G | 16 |
| 225 | I S E Y T M C L N E D Y T M G | 16 |
| 260 | D N V F A T P S P I I Q Q L E | 16 |
| 277 | D A E Y T N S P L V P T F C T | 16 |
| 375 | L S K Y N S N L A T P I A I K | 16 |
| 394 | S K R F L K H G Q N I R D V S | 16 |
| 58 | V N I L L D K A R L E N Q E G | 15 |
| 79 | T K V L M E K N S M D I M K I | 15 |
| 321 | D L E V E D R T S L V L N S D | 15 |

TABLE 27-continued

| Pos | 1 2 3 4 5 6 7 8 9 0 1 2 3 4 5 | score |
|---|---|---|
| 371 | I L Q L L S K Y N S N L A T P | 15 |
| 1 | M D P I R S F C G K L R S L A | 14 |
| 11 | L R S L A S T L D C E T A R L | 14 |
| 22 | T A R L Q R A L D G E E S D F | 14 |
| 55 | K D D V N I L L D K A R L E N | 14 |
| 57 | D V N I L L D K A R L E N Q E | 14 |
| 80 | K V L M E K N S M D I M K I R | 14 |
| 90 | I M K I R E Y F Q K Y G Y S P | 14 |
| 103 | S P R V K K N S V H E Q E A I | 14 |
| 108 | K N S V H E Q E A I N S D P E | 14 |
| 135 | K D D L S D P P V A S S C I S | 14 |
| 140 | D P P V A S S C I S E K S P R | 14 |
| 155 | S P Q L S D F G L E R Y I V S | 14 |
| 160 | D P G L E R Y I V S Q V L P N | 14 |
| 165 | R Y I V S Q V L P N P P Q A V | 14 |
| 168 | V S Q V L P N P P Q A V N N Y | 14 |
| 176 | P Q A V N N Y K E E P V I V T | 14 |
| 184 | E E P V I V T P P T K Q S L V | 14 |
| 186 | P V I V T P P T K Q S L V K V | 14 |
| 197 | L V K V L K T P K C A L K M D | 14 |
| 198 | V K V L K T P K C A L K M D D | 14 |
| 207 | A L K M D D F E C V T P K L E | 14 |
| 217 | T P K L E H F G I S E Y T M C | 14 |
| 222 | H F G I S E Y T M C L N E D Y | 14 |
| 227 | E Y T M C L N E D Y T M G L K | 14 |
| 270 | I Q Q L E K S D A E Y T N S P | 14 |
| 302 | S I A L V S T N Y P L S K T N | 14 |
| 303 | I A L V S T N Y P L S K T N S | 14 |
| 328 | T S L V L N S D T C F E N L T | 14 |
| 346 | S P T I S S Y E N L L R T P T | 14 |
| 352 | Y E N L L R T P T P P E V T K | 14 |
| 353 | E N L L R T P T P P E V T K I | 14 |
| 379 | N S N L A T P I A I K A V P P | 14 |
| 385 | P I A I K A V P P S K R F L K | 14 |
| 395 | K R F L K H G Q N I R D V S N | 14 |

(SEQ ID NOS 2866-2931, respectively, in order of appearance)
HLA-DRB1*1101 15-mers

| Pos | 1 2 3 4 5 6 7 8 9 0 1 2 3 4 5 | score |
|---|---|---|
| 99 | K Y G Y S P R V K K N S V H E | 26 |
| 267 | S P I I Q Q L E K S D A E Y T | 26 |
| 369 | E D I L Q L L S K Y N S N L A | 26 |
| 4 | I R S F C G K L R S L A S T L | 25 |
| 349 | I S S Y E N L L R T P T P P E | 24 |
| 335 | D T C F E N L T D P S S P T I | 22 |
| 194 | K Q S L V K V L K T P K C A L | 20 |
| 233 | N E D Y T M G L K N A R N N K | 20 |
| 306 | V S T N Y P L S K T N S S S N | 20 |
| 72 | G I D F I K A T K V L M E K N | 19 |
| 97 | F Q K Y G Y S P R V K K N S V | 19 |
| 38 | D Y P M R I L Y D L H S E V Q | 18 |
| 165 | R Y I V S Q V L P N P P Q A V | 18 |
| 300 | K N S I A L V S T N Y P L S K | 18 |
| 93 | I R E Y F Q K Y G Y S P R V K | 17 |
| 158 | L S D F G L E R Y I V S Q V L | 17 |
| 191 | P P T K Q S L V K V L K T P K | 17 |
| 210 | M D D F E C V T P K L E H F G | 17 |
| 286 | V P T F C T P G L K I P S T K | 17 |
| 2 | D P I R S F C G K L R S L A S | 16 |
| 56 | D D V N I L L D K A R L E N Q | 16 |
| 84 | E K N S M D I M K I R E Y F Q | 16 |
| 157 | Q L S D F G L E R Y I V S Q V | 16 |
| 186 | P V I V T P P T K Q S L V K V | 16 |
| 287 | P T F C T P G L K I P S T K N | 16 |
| 307 | S T N Y P L S K T N S S S N D | 16 |
| 19 | D C E T A R L Q R A L D G E E | 15 |
| 128 | N F Q K T D V K D D L S D P P | 15 |
| 319 | S N D L E V E D R T S L V L N | 15 |
| 361 | P P E V T K I P E D I L Q L L | 15 |
| 381 | N L A T P I A I K A V P P S K | 15 |
| 388 | I K A V P P S K R F L K H G Q | 15 |
| 397 | F L K H G Q N I R D V S N K E | 15 |
| 40 | P M R I L Y D L H S E V Q T L | 14 |
| 58 | V N I L L D K A R L E N Q E G | 14 |
| 77 | K A T K V L M E K N S M D I M | 14 |
| 100 | Y G Y S P R V K K N S V H E Q | 14 |
| 164 | E R Y I V S Q V L P N P P Q A | 14 |
| 175 | P P Q A V N N Y K E E P V I V | 14 |
| 195 | Q S L V K V L K T P K C A L K | 14 |

TABLE 27-continued

| Pos | 1 2 3 4 5 6 7 8 9 0 1 2 3 4 5 | score |
|---|---|---|
| 197 | L V K V L K T P K C A L K M D | 14 |
| 213 | F E C V T P K L E H F G I S E | 14 |
| 214 | E C V T P K L E H F G I S E Y | 14 |
| 249 | E E A I D T E S R L N D N V F | 14 |
| 255 | E S R L N D N V F A T P S P I | 14 |
| 358 | T P T P P E V T K I P E D I L | 14 |
| 392 | P P S K R F L K H G Q N I R D | 14 |
| 8 | C G K L R S L A S T L D C E T | 13 |
| 41 | M R I L Y D L H S E V Q T L K | 13 |
| 48 | H S E V Q T L K D D V N I L L | 13 |
| 54 | L K D D V N I L L D K A R L E | 13 |
| 67 | L E N Q E G I D F I K A T K V | 13 |
| 70 | Q E G I D F I K A T K V L M E | 13 |
| 76 | I K A T K V L M E K N S M D I | 13 |
| 85 | K N S M D I M K I R E Y F Q K | 13 |
| 145 | S S C I S E K S P R S P Q L S | 13 |
| 162 | G L E R Y I V S Q V L P N P P | 13 |
| 237 | T M G L K N A R N N K S E E A | 13 |
| 293 | G L K I P S T K N S I A L V S | 13 |
| 302 | S I A L V S T N Y P L S K T N | 13 |
| 318 | S S N D L E V E D R T S L V L | 13 |
| 365 | T K I P E D I L Q L L S K Y N | 13 |
| 372 | L Q L L S K Y N S N L A T P I | 13 |
| 376 | S K Y N S N L A T P I A I K A | 13 |
| 379 | N S N L A T P I A I K A V P P | 13 |
| 385 | P I A I K A V P P S K R F L K | 13 |

MHC Class II 15-mer analysis of amino acids 136-164 (DDLSDPPVASSCISGKSPRSPQLSDFGLE) (SEQ ID NO:2932) of 193P1E1b version 2 that contains an E to G mutation at amino acid 150. Listed are those alleles and peptides in which the score falls within the top 50% (rounded up) of the scores from the analysis of the version 1 sequence.
(SEQ ID NOS 2933-2935, respectively, in order of appearance)
HLA-DRB1*0101 15-mers

| 142 | P V A S S C I S G K S P R S P | 23 |
|---|---|---|
| 145 | S S C I S G K S P R S P Q L S | 23 |
| 137 | D L S D P P V A S S C I S G K | 20 |

(SEQ ID NOS 2936-2938, respectively, in order of appearance)
HLA-DRB1*0401 (DR4Dw4) 15-mers

| 137 | D L S D P P V A S S C I S G K | 18 |
|---|---|---|
| 138 | L S D P P V A S S C I S G K S | 18 |
| 140 | D P P V A S S C I S G K S P R | 14 |

(SEQ ID NOS 2939)
HLA-DRB1*1101 15-mers

| 145 | S S C I S G K S P R S P Q L S | 13 |

MHC Class II 15-mer analysis of amino acids 240-268 (LKNARNNKSEEAIDTESRLNDNVFATPSP) (SEQ ID NO:2940) of 193P1E1b variant 3 that contains a T to A mutation at amino acid 254. Listed are those alleles and peptides in which the score falls within the top 50% (rounded up) of the scores from the analysis of the variant 1 base peptide sequence.
(SEQ ID NOS 2941-2942, respectively, in order of appearance)
HLA-DRB1*0101 15-mers

| 240 | L K N A R N N K S E E A I D T | 16 |
|---|---|---|
| 252 | I D T E S R L N D N V F A T P | 16 |

(SEQ ID NOS 2943-2944, respectively, in order of appearance)
HLA-DRB1*0301 (DR17) 15-mers

| 247 | K S E E A I D T E S R L N D N | 24 |
|---|---|---|
| 249 | E E A I D T E S R L N D N V F | 19 |

(SEQ ID NO:2945)
HLA-DRB1*0401 (DR4Dw4) 15-mers

| 249 | E E A I D T E S R L N D N V F | 20 |

(SEQ ID NO:2946)
HLA-DRB1*1101 15-mers

| 249 | E E A I D T E S R L N D N V F | 14 |

MHC Class II 15-mer analysis of amino acids 360-373 to 374*-388* (TPPEVTKIPEDILQKFQWIYPTQKLNKMR) (SEQ ID NO:2947) of 193P1E1b variants 4 and 5 that delete amino acids 374-412 of variant 1 and encode new amino acids 374*-388* (underlined). Listed are those alleles and peptides in which the score falls within the top 50% (rounded up) of the scores from the analysis of the variant 1 base peptide sequence.
(SEQ ID NOS 2948-2952, respectively, in order of appearance)
HLA-DRB1*0101 15-mers

| 361 | P P E V T K I P E D I L Q K F | 25 |
|---|---|---|
| 372 | L Q K F Q W I Y P T Q K L N K | 23 |
| 369 | E D I L Q K F Q W I Y P T Q K | 18 |
| 373 | Q K F Q W I Y P T Q K L N K M | 18 |
| 364 | V T K I P E D I L Q K F Q W I | 17 |

(SEQ ID NOS 2953-2955, respectively. in order of appearance)
HLA-DRB1*0301 (DR17) 15-mers

| 364 | V T K I P E D I L Q K F Q W I | 31 |
|---|---|---|
| 361 | P P E V T K I P E D I L Q K F | 26 |
| 9 | P E D I L Q K F Q W I Y P T Q | 26 |

TABLE 27-continued

| Pos | 1 2 3 4 5 6 7 8 9 0 1 2 3 4 5 | score |
|---|---|---|
| (SEQ ID NOS 2956-2961, respectively, in order of appearance) HLA-DRB1*0401 (DR4Dw4) 15-mers | | |
| 13 | L Q K F Q W I Y P T Q K L N K | 22 |
| 15 | K F Q W I Y P T Q K L N K M R | 22 |
| 2 | P P E V T K I P E D I L Q K F | 20 |
| 6 | T K I P E D I L Q K F Q W I Y | 18 |
| 5 | V T K I P E D I L Q K F Q W I | 14 |
| 10 | E D I L Q K F Q W I Y P T Q K | 14 |
| (SEQ ID NOS 2962-2964, respectively, in order of appearance) HLA-DRB1*1101 15-mers | | |
| 13 | L Q K F Q W I Y P T Q K L N K | 16 |
| 2 | P P E V T K I P E D I L Q K F | 15 |
| 7 | K I P E D I L Q K F Q W I Y P | 14 |
| MHC Class II 15-mer analysis of amino acids 21-34 and 374-387 of 193P1E1b variant 6 (ETARLQRALDGEESLLSKYNSNLATPIA) (SEQ ID NO:2965). Listed are those alleles and peptides in which the score falls within the top 50% (rounded up) of the scores from the analysis of variant 1 base peptide sequence. (SEQ ID NOS 2966-2970, respectively, in order of appearance) HLA-DRB1*0101 15-mers | | |
| 3 | A R L Q R A L D G E E S L L S | 26 |
| 13 | E S L L S K Y N S N L A T P I | 24 |
| 6 | Q R A L D G E E S L L S K Y N | 23 |
| 10 | D G E E S L L S K Y N S N L A | 17 |
| 12 | E E S L L S K Y N S N L A T P | 16 |
| (SEQ ID NOS 2971-2973, respectively, in order of appearance) HLA-DRB1*0301 (DR17) 15-mers | | |
| 12 | E E S L L S K Y N S N L A T P | 28 |
| 4 | R L Q R A L D G E E S L L S K | 26 |
| 5 | L Q R A L D G E E S L L S K Y | 18 |
| (SEQ ID NOS 2974-2978, respectively, in order of appearance) HLA-DRB1*0401 (DR4Dw4) 15-mers | | |
| 6 | Q R A L D G E E S L L S K Y N | 26 |
| 13 | E S L L S K Y N S N L A T P I | 20 |
| 9 | L D G E E S L L S K Y N S N L | 18 |
| 12 | E E S L L S K Y N S N L A T P | 15 |
| 2 | T A R L Q R A L D G E E S L L | 14 |
| (SEQ ID NOS 2979-2981, respectively, in order of appearance) HLA-DRB1*1101 15-mers | | |
| 10 | D G E E S L L S K Y N S N L A | 20 |
| 6 | Q R A L D G E E S L L S K Y N | 13 |
| 13 | E S L L S K Y N S N L A T P I | 13 |

SEQUENCE LISTING (3005 sequences)

SEQ ID NO: 1 - protein, 9 aa, Homo sapiens
DCETARLQR

SEQ ID NO: 2 - protein, 9 aa, Homo sapiens
LSDFGLERY

SEQ ID NO: 3 - protein, 9 aa, Homo sapiens
LTDPSSPTI

SEQ ID NO: 4 - protein, 9 aa, Homo sapiens
GIDFIKATK

SEQ ID NO: 5 - protein, 9 aa, Homo sapiens
LSDPPVASS

SEQ ID NO: 6 - protein, 9 aa, Homo sapiens
NQEGIDFIK

SEQ ID NO: 7 - protein, 9 aa, Homo sapiens
QLEKSDAEY

SEQ ID NO: 8 - protein, 9 aa, Homo sapiens
NSDPELSNC

SEQ ID NO: 9 - protein, 9 aa, Homo sapiens
ALDGEESDF

SEQ ID NO: 10 - protein, 9 aa, Homo sapiens
GEESDFEDY

SEQ ID NO: 11 - protein, 9 aa, Homo sapiens
DTESRLNDN

SEQ ID NO: 12 - protein, 9 aa, Homo sapiens
LSNCENFQK

SEQ ID NO: 13 - protein, 9 aa, Homo sapiens
ESDFEDYPM

SEQ ID NO: 14 - protein, 9 aa, Homo sapiens
VSTNYPLSK

SEQ ID NO: 15 - protein, 9 aa, Homo sapiens
ISEYTMCLN

SEQ ID NO: 16 - protein, 9 aa, Homo sapiens
KTDVKDDLS

SEQ ID NO: 17 - protein, 9 aa, Homo sapiens
EDYPMRILY

SEQ ID NO: 18 - protein, 9 aa, Homo sapiens
SNDLEVEDR

SEQ ID NO: 19 - protein, 9 aa, Homo sapiens
YTMCLNEDY

SEQ ID NO: 20 - protein, 9 aa, Homo sapiens
LNEDYTMGL

SEQ ID NO: 21 - protein, 9 aa, Homo sapiens
KAVPPSKRF

SEQ ID NO: 22 - protein, 9 aa, Homo sapiens
TPTPPEVTK

SEQ ID NO: 23 - protein, 9 aa, Homo sapiens
CVTPKLEHF

SEQ ID NO: 24 - protein, 9 aa, Homo sapiens
TLDCETARL

SEQ ID NO: 25 - protein, 9 aa, Homo sapiens
DLEVEDRTS

SEQ ID NO: 26 - protein, 9 aa, Homo sapiens
DAEYTNSPL

SEQ ID NO: 27 - protein, 9 aa, Homo sapiens
EVEDRTSLV

SEQ ID NO: 28 - protein, 9 aa, Homo sapiens
PSSPTISSY

SEQ ID NO: 29 - protein, 9 aa, Homo sapiens
KSDAEYTNS

SEQ ID NO: 30 - protein, 9 aa, Homo sapiens
NSDTCFENL

SEQ ID NO: 31 - protein, 9 aa, Homo sapiens
ISSYENLLR

SEQ ID NO: 32 - protein, 9 aa, Homo sapiens
HSEVQTLKD

SEQ ID NO: 33 - protein, 9 aa, Homo sapiens
FATPSPIIQ

SEQ ID NO: 34 - protein, 9 aa, Homo sapiens
LATPIAIKA

SEQ ID NO: 35 - protein, 9 aa, Homo sapiens
SIALVSTNY

SEQ ID NO: 36 - protein, 9 aa, Homo sapiens
AIDTESRLN

SEQ ID NO: 37 - protein, 9 aa, Homo sapiens
NEDYTMGLK

SEQ ID NO: 38 - protein, 9 aa, Homo sapiens
DILQLLSKY

SEQ ID NO: 39 - protein, 9 aa, Homo sapiens
TNSPLVPTF

SEQ ID NO: 40 - protein, 9 aa, Homo sapiens
QLSDFGLER

SEQ ID NO: 41 - protein, 9 aa, Homo sapiens
KLEHFGISE

SEQ ID NO: 42 - protein, 9 aa, Homo sapiens
NLATPIAIK

SEQ ID NO: 43 - protein, 9 aa, Homo sapiens
STLDCETAR

SEQ ID NO: 44 - protein, 9 aa, Homo sapiens
SPIIQQLEK

SEQ ID NO: 45 - protein, 9 aa, Homo sapiens
LLDKARLEN

SEQ ID NO: 46 - protein, 9 aa, Homo sapiens
YTMGLKNAR

SEQ ID NO: 47 - protein, 9 aa, Homo sapiens
VTPPTKQSL

SEQ ID NO: 48 - protein, 9 aa, Homo sapiens
KMDDFECVT

SEQ ID NO: 49 - protein, 9 aa, Homo sapiens
VPPSKRFLK

SEQ ID NO: 50 - protein, 9 aa, Homo sapiens
LMEKNSMDI

SEQ ID NO: 51 - protein, 10 aa, Homo sapiens
RLENQEGIDF

SEQ ID NO: 52 - protein, 10 aa, Homo sapiens
KLEHFGISEY

SEQ ID NO: 53 - protein, 10 aa, Homo sapiens
ESDFEDYPMR

SEQ ID NO: 54 - protein, 10 aa, Homo sapiens
LTDPSSPTIS

SEQ ID NO: 55 - protein, 10 aa, Homo sapiens
SMDIMKIREY

SEQ ID NO: 56 - protein, 10 aa, Homo sapiens
DGEESDFEDY

SEQ ID NO: 57 - protein, 10 aa, Homo sapiens
AVPPSKRFLK

SEQ ID NO: 58 - protein, 10 aa, Homo sapiens
LSDPPVASSC

SEQ ID NO: 59 - protein, 10 aa, Homo sapiens
FEDYPMRILY

SEQ ID NO: 60 - protein, 10 aa, Homo sapiens
IREYFQKYGY

SEQ ID NO: 61 - protein, 10 aa, Homo sapiens
LNEDYTMGLK

SEQ ID NO: 62 - protein, 10 aa, Homo sapiens
EVEDRTSLVL

SEQ ID NO: 63 - protein, 10 aa, Homo sapiens
KDDVNILLDK

SEQ ID NO: 64 - protein, 10 aa, Homo sapiens
DTESRLNDNV

SEQ ID NO: 65 - protein, 10 aa, Homo sapiens
DPELSNCENF

SEQ ID NO: 66 - protein, 10 aa, Homo sapiens
DAEYTNSPLV

SEQ ID NO: 67 - protein, 10 aa, Homo sapiens
KSEEAIDTES

SEQ ID NO: 68 - protein, 10 aa, Homo sapiens
IPEDILQLLS

SEQ ID NO: 69 - protein, 10 aa, Homo sapiens
ELSNCENFQK

SEQ ID NO: 70 - protein, 10 aa, Homo sapiens
RTPTPPEVTK

SEQ ID NO: 71 - protein, 10 aa, Homo sapiens
LVSTNYPLSK

SEQ ID NO: 72 - protein, 10 aa, Homo sapiens
NCENFQKTDV

SEQ ID NO: 73 - protein, 10 aa, Homo sapiens
DLEVEDRTSL

SEQ ID NO: 74 - protein, 10 aa, Homo sapiens
DCETARLQRA

SEQ ID NO: 75 - protein, 10 aa, Homo sapiens
NSDPELSNCE

SEQ ID NO: 76 - protein, 10 aa, Homo sapiens
LSDFGLERYI

SEQ ID NO: 77 - protein, 10 aa, Homo sapiens
NSDTCFENLT

SEQ ID NO: 78 - protein, 10 aa, Homo sapiens
NSIALVSTNY

SEQ ID NO: 79 - protein, 10 aa, Homo sapiens
ISEYTMCLNE

SEQ ID NO: 80 - protein, 10 aa, Homo sapiens
NQEGIDFIKA

SEQ ID NO: 81 - protein, 10 aa, Homo sapiens
KTDVKDDLSD

SEQ ID NO: 82 - protein, 10 aa, Homo sapiens
FATPSPIIQQ

SEQ ID NO: 83 - protein, 10 aa, Homo sapiens
QLSDFGLERY

SEQ ID NO: 84 - protein, 10 aa, Homo sapiens
TLDCETARLQ

SEQ ID NO: 85 - protein, 10 aa, Homo sapiens
FCTPGLKIPS

SEQ ID NO: 86 - protein, 10 aa, Homo sapiens
TISSYENLLR

SEQ ID NO: 87 - protein, 10 aa, Homo sapiens
MDDFECVTPK

SEQ ID NO: 88 - protein, 10 aa, Homo sapiens
GIDFIKATKV

SEQ ID NO: 89 - protein, 10 aa, Homo sapiens
YTNSPLVPTF

SEQ ID NO: 90 - protein, 10 aa, Homo sapiens
SEEAIDTESR

SEQ ID NO: 91 - protein, 10 aa, Homo sapiens
PEDILQLLSK

SEQ ID NO: 92 - protein, 10 aa, Homo sapiens
AIDTESRLND

SEQ ID NO: 93 - protein, 10 aa, Homo sapiens
VTPPTKQSLV

SEQ ID NO: 94 - protein, 10 aa, Homo sapiens
ENQEGIDFIK

SEQ ID NO: 95 - protein, 10 aa, Homo sapiens
TPPTKQSLVK

SEQ ID NO: 96 - protein, 10 aa, Homo sapiens
DLHSEVQTLK

SEQ ID NO: 97 - protein, 10 aa, Homo sapiens
PSPIIQQLEK

SEQ ID NO: 98 - protein, 10 aa, Homo sapiens
SSCISEKSPR

SEQ ID NO: 99 - protein, 10 aa, Homo sapiens
QQLEKSDAEY

SEQ ID NO: 100 - protein, 10 aa, Homo sapiens
SSNDLEVEDR

SEQ ID NO: 101 - protein, 9 aa, Homo sapiens
ILYDLHSEV

SEQ ID NO: 102 - protein, 9 aa, Homo sapiens
RLNDNVFAT

SEQ ID NO: 103 - protein, 9 aa, Homo sapiens
VLPNPPQAV

SEQ ID NO: 104 - protein, 9 aa, Homo sapiens
KIPEDILQL

SEQ ID NO: 105 - protein, 9 aa, Homo sapiens
KMDDFECVT

SEQ ID NO: 106 - protein, 9 aa, Homo sapiens
LLSKYNSNL

SEQ ID NO: 107 - protein, 9 aa, Homo sapiens
NLTDPSSPT

SEQ ID NO: 108 - protein, 9 aa, Homo sapiens
ALVSTNYPL

SEQ ID NO: 109 - protein, 9 aa, Homo sapiens
TMCLNEDYT

SEQ ID NO: 110 - protein, 9 aa, Homo sapiens
GISEYTMCL

SEQ ID NO: 111 - protein, 9 aa, Homo sapiens
NILLDKARL

SEQ ID NO: 112 - protein, 9 aa, Homo sapiens
TLDCETARL

SEQ ID NO: 113 - protein, 9 aa, Homo sapiens
KLRSLASTL

SEQ ID NO: 114 - protein, 9 aa, Homo sapiens
KVLKTPKCA

SEQ ID NO: 115 - protein, 9 aa, Homo sapiens
KVLMEKNSM

SEQ ID NO: 116 - protein, 9 aa, Homo sapiens
YPMRILYDL

SEQ ID NO: 117 - protein, 9 aa, Homo sapiens
KIPSTKNSI

SEQ ID NO: 118 - protein, 9 aa, Homo sapiens
AEYTNSPLV

SEQ ID NO: 119 - protein, 9 aa, Homo sapiens
DLHSEVQTL

SEQ ID NO: 120 - protein, 9 aa, Homo sapiens
NVFATPSPI

SEQ ID NO: 121 - protein, 9 aa, Homo sapiens
TISSYENLL

SEQ ID NO: 122 - protein, 9 aa, Homo sapiens
LEVEDRTSL

SEQ ID NO: 123 - protein, 9 aa, Homo sapiens
TLKDDVNIL

SEQ ID NO: 124 - protein, 9 aa, Homo sapiens
SLVLNSDTC

SEQ ID NO: 125 - protein, 9 aa, Homo sapiens
LKMDDFECV

SEQ ID NO: 126 - protein, 9 aa, Homo sapiens
ATPIAIKAV

SEQ ID NO: 127 - protein, 9 aa, Homo sapiens
AVPPSKRFL

SEQ ID NO: 128 - protein, 9 aa, Homo sapiens
QVLPNPPQA

SEQ ID NO: 129 - protein, 9 aa, Homo sapiens
SSYENLLRT

SEQ ID NO: 130 - protein, 9 aa, Homo sapiens
CENFQKTDV

SEQ ID NO: 131 - protein, 9 aa, Homo sapiens
VLKTPKCAL

SEQ ID NO: 132 - protein, 9 aa, Homo sapiens
YTNSPLVPT

SEQ ID NO: 133 - protein, 9 aa, Homo sapiens
SPLVPTFCT

SEQ ID NO: 134 - protein, 9 aa, Homo sapiens
KTNSSSNDL

SEQ ID NO: 135 - protein, 9 aa, Homo sapiens
ALKMDDFEC

SEQ ID NO: 136 - protein, 9 aa, Homo sapiens
IQQLEKSDA

SEQ ID NO: 137 - protein, 9 aa, Homo sapiens
LMEKNSMDI

SEQ ID NO: 138 - protein, 9 aa, Homo sapiens
SPQLSDFGL

SEQ ID NO: 139 - protein, 9 aa, Homo sapiens
ILQLLSKYN

SEQ ID NO: 140 - protein, 9 aa, Homo sapiens
YENLLRTPT

SEQ ID NO: 141 - protein, 9 aa, Homo sapiens
TESRLNDNV

SEQ ID NO: 142 - protein, 9 aa, Homo sapiens
IDFIKATKV

SEQ ID NO: 143 - protein, 9 aa, Homo sapiens
KNSMDIMKI

SEQ ID NO: 144 - protein, 9 aa, Homo sapiens
QTLKDDVNI

SEQ ID NO: 145 - protein, 9 aa, Homo sapiens
VTPPTKQSL

SEQ ID NO: 146 - protein, 9 aa, Homo sapiens
CLNEDYTMG

SEQ ID NO: 147 - protein, 9 aa, Homo sapiens
NSSSNDLEV

SEQ ID NO: 148 - protein, 9 aa, Homo sapiens
TPPTKQSLV

SEQ ID NO: 149 - protein, 9 aa, Homo sapiens
QSLVKVLKT

SEQ ID NO: 150 - protein, 9 aa, Homo sapiens
QLLSKYNSN

SEQ ID NO: 151 - protein, 10 aa, Homo sapiens
VLMEKNSMDI

SEQ ID NO: 152 - protein, 10 aa, Homo sapiens
KIPEDILQLL

SEQ ID NO: 153 - protein, 10 aa, Homo sapiens
CLNEDYTMGL

SEQ ID NO: 154 - protein, 10 aa, Homo sapiens
QLLSKYNSNL

SEQ ID NO: 155 - protein, 10 aa, Homo sapiens
NLTDPSSPTI

SEQ ID NO: 156 - protein, 10 aa, Homo sapiens
RILYDLHSEV

SEQ ID NO: 157 - protein, 10 aa, Homo sapiens
KVLKTPKCAL

SEQ ID NO: 158 - protein, 10 aa, Homo sapiens
QVLPNPPQAV

SEQ ID NO: 159 - protein, 10 aa, Homo sapiens
GLERYIVSQV

SEQ ID NO: 160 - protein, 10 aa, Homo sapiens
LEVEDRTSLV

SEQ ID NO: 161 - protein, 10 aa, Homo sapiens
LLRTPTPPEV

SEQ ID NO: 162 - protein, 10 aa, Homo sapiens
LLSKYNSNLA

SEQ ID NO: 163 - protein, 10 aa, Homo sapiens
SLASTLDCET

SEQ ID NO: 164 - protein, 10 aa, Homo sapiens
KQSLVKVLKT

SEQ ID NO: 165 - protein, 10 aa, Homo sapiens
NLATPIAIKA

SEQ ID NO: 166 - protein, 10 aa, Homo sapiens
YTMCLNEDYT

SEQ ID NO: 167 - protein, 10 aa, Homo sapiens
STLDCETARL

SEQ ID NO: 168 - protein, 10 aa, Homo sapiens
GIDFIKATKV

SEQ ID NO: 169 - protein, 10 aa, Homo sapiens
LATPIAIKAV

SEQ ID NO: 170 - protein, 10 aa, Homo sapiens
TMCLNEDYTM

SEQ ID NO: 171 - protein, 10 aa, Homo sapiens
LVPTFCTPGL

SEQ ID NO: 172 - protein, 10 aa, Homo sapiens
IVTPPTKQSL

SEQ ID NO: 173 - protein, 10 aa, Homo sapiens
TLKDDVNILL

SEQ ID NO: 174 - protein, 10 aa, Homo sapiens
AVNNYKEEPV

SEQ ID NO: 175 - protein, 10 aa, Homo sapiens
ALKMDDFECV

SEQ ID NO: 176 - protein, 10 aa, Homo sapiens
LENQEGIDFI

SEQ ID NO: 177 - protein, 10 aa, Homo sapiens
YSPRVKKNSV

SEQ ID NO: 178 - protein, 10 aa, Homo sapiens
ILLDKARLEN

SEQ ID NO: 179 - protein, 10 aa, Homo sapiens
IALVSTNYPL

SEQ ID NO: 180 - protein, 10 aa, Homo sapiens
VQTLKDDVNI

SEQ ID NO: 181 - protein, 10 aa, Homo sapiens
VTPPTKQSLV

SEQ ID NO: 182 - protein, 10 aa, Homo sapiens
CALKMDDFEC

SEQ ID NO: 183 - protein, 10 aa, Homo sapiens
VTPKLEHFGI

SEQ ID NO: 184 - protein, 10 aa, Homo sapiens
NVFATPSPII

SEQ ID NO: 185 - protein, 10 aa, Homo sapiens
QLEKSDAEYT

SEQ ID NO: 186 - protein, 10 aa, Homo sapiens
QEGIDFIKAT

SEQ ID NO: 187 - protein, 10 aa, Homo sapiens
YDLHSEVQTL

SEQ ID NO: 188 - protein, 10 aa, Homo sapiens
IIQQLEKSDA

SEQ ID NO: 189 - protein, 10 aa, Homo sapiens
KAVPPSKRFL

SEQ ID NO: 190 - protein, 10 aa, Homo sapiens
FQKYGYSPRV

SEQ ID NO: 191 - protein, 10 aa, Homo sapiens
QTLKDDVNIL

SEQ ID NO: 192 - protein, 10 aa, Homo sapiens
KIPSTKNSIA

SEQ ID NO: 193 - protein, 10 aa, Homo sapiens
LNSDTCFENL

SEQ ID NO: 194 - protein, 10 aa, Homo sapiens
RSPQLSDFGL

SEQ ID NO: 195 - protein, 10 aa, Homo sapiens
VLNSDTCFEN

SEQ ID NO: 196 - protein, 10 aa, Homo sapiens
ATPSPIIQQL

SEQ ID NO: 197 - protein, 10 aa, Homo sapiens
LEHFGISEYT

SEQ ID NO: 198 - protein, 10 aa, Homo sapiens
SEVQTLKDDV

SEQ ID NO: 199 - protein, 10 aa, Homo sapiens
FGISEYTMCL

SEQ ID NO: 200 - protein, 10 aa, Homo sapiens
NNYKEEPVIV

SEQ ID NO: 201 - protein, 9 aa, Homo sapiens
GLKNARNNK

SEQ ID NO: 202 - protein, 9 aa, Homo sapiens
NLATPIAIK

SEQ ID NO: 203 - protein, 9 aa, Homo sapiens
QLSDFGLER

SEQ ID NO: 204 - protein, 9 aa, Homo sapiens
KIREYFQKY

SEQ ID NO: 205 - protein, 9 aa, Homo sapiens
GIDFIKATK

SEQ ID NO: 206 - protein, 9 aa, Homo sapiens
NQEGIDFIK

SEQ ID NO: 207 - protein, 9 aa, Homo sapiens
FLKHGQNIR

SEQ ID NO: 208 - protein, 9 aa, Homo sapiens
QLEKSDAEY

SEQ ID NO: 209 - protein, 9 aa, Homo sapiens
AIKAVPPSK

SEQ ID NO: 210 - protein, 9 aa, Homo sapiens
ALDGEESDF

SEQ ID NO: 211 - protein, 9 aa, Homo sapiens
ALVSTNYPL

SEQ ID NO: 212 - protein, 9 aa, Homo sapiens
KQSLVKVLK

SEQ ID NO: 213 - protein, 9 aa, Homo sapiens
KATKVLMEK

SEQ ID NO: 214 - protein, 9 aa, Homo sapiens
LVKVLKTPK

SEQ ID NO: 215 - protein, 9 aa, Homo sapiens
KLRSLASTL

SEQ ID NO: 216 - protein, 9 aa, Homo sapiens
LLSKYNSNL

SEQ ID NO: 217 - protein, 9 aa, Homo sapiens
TLKDDVNIL

SEQ ID NO: 218 - protein, 9 aa, Homo sapiens
GISEYTMCL

SEQ ID NO: 219 - protein, 9 aa, Homo sapiens
LMEKNSMDI

SEQ ID NO: 220 - protein, 9 aa, Homo sapiens
ILYDLHSEV

SEQ ID NO: 221 - protein, 9 aa, Homo sapiens
RLNDNVFAT

SEQ ID NO: 222 - protein, 9 aa, Homo sapiens
VLKTPKCAL

SEQ ID NO: 223 - protein, 9 aa, Homo sapiens
KMDDFECVT

SEQ ID NO: 224 - protein, 9 aa, Homo sapiens
KIPEDILQL

SEQ ID NO: 225 - protein, 9 aa, Homo sapiens
SIALVSTNY

SEQ ID NO: 226 - protein, 9 aa, Homo sapiens
SPIIQQLEK

SEQ ID NO: 227 - protein, 9 aa, Homo sapiens
ALKMDDFEC

SEQ ID NO: 228 - protein, 9 aa, Homo sapiens
TLDCETARL

SEQ ID NO: 229 - protein, 9 aa, Homo sapiens
VSTNYPLSK

SEQ ID NO: 230 - protein, 9 aa, Homo sapiens
VPPSKRFLK

SEQ ID NO: 231 - protein, 9 aa, Homo sapiens
DLHSEVQTL

SEQ ID NO: 232 - protein, 9 aa, Homo sapiens
CVTPKLEHF

SEQ ID NO: 233 - protein, 9 aa, Homo sapiens
YTMGLKNAR

SEQ ID NO: 234 - protein, 9 aa, Homo sapiens
TPTPPEVTK

SEQ ID NO: 235 - protein, 9 aa, Homo sapiens
KLEHFGISE

SEQ ID NO: 236 - protein, 9 aa, Homo sapiens
YTMCLNEDY

SEQ ID NO: 237 - protein, 9 aa, Homo sapiens
STLDCETAR

SEQ ID NO: 238 - protein, 9 aa, Homo sapiens
PVIVTPPTK

SEQ ID NO: 239 - protein, 9 aa, Homo sapiens
SLVLNSDTC

SEQ ID NO: 240 - protein, 9 aa, Homo sapiens
NVFATPSPI

SEQ ID NO: 241 - protein, 9 aa, Homo sapiens
VASSCISEK

SEQ ID NO: 242 - protein, 9 aa, Homo sapiens
VLPNPPQAV

SEQ ID NO: 243 - protein, 9 aa, Homo sapiens
LSNCENFQK

SEQ ID NO: 244 - protein, 9 aa, Homo sapiens
LVLNSDTCF

SEQ ID NO: 245 - protein, 9 aa, Homo sapiens
DPIRSFCGK

SEQ ID NO: 246 - protein, 9 aa, Homo sapiens
GLERYIVSQ

SEQ ID NO: 247 - protein, 9 aa, Homo sapiens
DILQLLSKY

SEQ ID NO: 248 - protein, 9 aa, Homo sapiens
QNIRDVSNK

SEQ ID NO: 249 - protein, 9 aa, Homo sapiens
REYFQKYGY

SEQ ID NO: 250 - protein, 9 aa, Homo sapiens
KIPSTKNSI

SEQ ID NO: 251 - protein, 10 aa, Homo sapiens
IMKIREYFQK

SEQ ID NO: 252 - protein, 10 aa, Homo sapiens
SLVKVLKTPK

SEQ ID NO: 253 - protein, 10 aa, Homo sapiens
VLKTPKCALK

SEQ ID NO: 254 - protein, 10 aa, Homo sapiens
KLEHFGISEY

SEQ ID NO: 255 - protein, 10 aa, Homo sapiens
ELSNCENFQK

SEQ ID NO: 256 - protein, 10 aa, Homo sapiens
LVSTNYPLSK

SEQ ID NO: 257 - protein, 10 aa, Homo sapiens
DLHSEVQTLK

SEQ ID NO: 258 - protein, 10 aa, Homo sapiens
AVPPSKRFLK

SEQ ID NO: 259 - protein, 10 aa, Homo sapiens
QLSDFGLERY

SEQ ID NO: 260 - protein, 10 aa, Homo sapiens
CLNEDYTMGL

SEQ ID NO: 261 - protein, 10 aa, Homo sapiens
GQNIRDVSNK

SEQ ID NO: 262 - protein, 10 aa, Homo sapiens
RLENQEGIDF

SEQ ID NO: 263 - protein, 10 aa, Homo sapiens
SLVLNSDTCF

SEQ ID NO: 264 - protein, 10 aa, Homo sapiens
VLMEKNSMDI

SEQ ID NO: 265 - protein, 10 aa, Homo sapiens
GLERYIVSQV

SEQ ID NO: 266 - protein, 10 aa, Homo sapiens
QLLSKYNSNL

SEQ ID NO: 267 - protein, 10 aa, Homo sapiens
TLKDDVNILL

SEQ ID NO: 268 - protein, 10 aa, Homo sapiens
RTPTPPEVTK

SEQ ID NO: 269 - protein, 10 aa, Homo sapiens
TISSYENLLR

SEQ ID NO: 270 - protein, 10 aa, Homo sapiens
KIPEDILQLL

SEQ ID NO: 271 - protein, 10 aa, Homo sapiens
ALKMDDFECV

SEQ ID NO: 272 - protein, 10 aa, Homo sapiens
NLTDPSSPTI

SEQ ID NO: 273 - protein, 10 aa, Homo sapiens
SMDIMKIREY

SEQ ID NO: 274 - protein, 10 aa, Homo sapiens
NLATPIAIKA

SEQ ID NO: 275 - protein, 10 aa, Homo sapiens
TMCLNEDYTM

SEQ ID NO: 276 - protein, 10 aa, Homo sapiens
AIKAVPPSKR

SEQ ID NO: 277 - protein, 10 aa, Homo sapiens
IAIKAVPPSK

SEQ ID NO: 278 - protein, 10 aa, Homo sapiens
NVFATPSPII

SEQ ID NO: 279 - protein, 10 aa, Homo sapiens
KVLKTPKCAL

SEQ ID NO: 280 - protein, 10 aa, Homo sapiens
TPPTKQSLVK

SEQ ID NO: 281 - protein, 10 aa, Homo sapiens
NPPQAVNNYK

SEQ ID NO: 282 - protein, 10 aa, Homo sapiens
YTNSPLVPTF

SEQ ID NO: 283 - protein, 10 aa, Homo sapiens
LMEKNSMDIM

SEQ ID NO: 284 - protein, 10 aa, Homo sapiens
PVASSCISEK

SEQ ID NO: 285 - protein, 10 aa, Homo sapiens
TPGLKIPSTK

SEQ ID NO: 286 - protein, 10 aa, Homo sapiens
KDDVNILLDK

SEQ ID NO: 287 - protein, 10 aa, Homo sapiens
QQLEKSDAEY

SEQ ID NO: 288 - protein, 10 aa, Homo sapiens
LLRTPTPPEV

SEQ ID NO: 289 - protein, 10 aa, Homo sapiens
LLSKYNSNLA

SEQ ID NO: 290 - protein, 10 aa, Homo sapiens
DLEVEDRTSL

SEQ ID NO: 291 - protein, 10 aa, Homo sapiens
QTLKDDVNIL

SEQ ID NO: 292 - protein, 10 aa, Homo sapiens
SNLATPIAIK

SEQ ID NO: 293 - protein, 10 aa, Homo sapiens
MEKNSMDIMK

SEQ ID NO: 294 - protein, 10 aa, Homo sapiens
GLKNARNNKS

SEQ ID NO: 295 - protein, 10 aa, Homo sapiens
ILQLLSKYNS

SEQ ID NO: 296 - protein, 10 aa, Homo sapiens
PQLSDFGLER

SEQ ID NO: 297 - protein, 10 aa, Homo sapiens
ILYDLHSEVQ

SEQ ID NO: 298 - protein, 10 aa, Homo sapiens
SLASTLDCET

SEQ ID NO: 299 - protein, 10 aa, Homo sapiens
QLEKSDAEYT

SEQ ID NO: 300 - protein, 10 aa, Homo sapiens
IKATKVLMEK

SEQ ID NO: 301 - protein, 9 aa, Homo sapiens
LVKVLKTPK

SEQ ID NO: 302 - protein, 9 aa, Homo sapiens
NQEGIDFIK

SEQ ID NO: 303 - protein, 9 aa, Homo sapiens
KQSLVKVLK

SEQ ID NO: 304 - protein, 9 aa, Homo sapiens
KATKVLMEK

SEQ ID NO: 305 - protein, 9 aa, Homo sapiens
GIDFIKATK

SEQ ID NO: 306 - protein, 9 aa, Homo sapiens
GLKNARNNK

SEQ ID NO: 307 - protein, 9 aa, Homo sapiens
SPIIQQLEK

SEQ ID NO: 308 - protein, 9 aa, Homo sapiens
VPPSKRFLK

SEQ ID NO: 309 - protein, 9 aa, Homo sapiens
AIKAVPPSK

SEQ ID NO: 310 - protein, 9 aa, Homo sapiens
NLATPIAIK

SEQ ID NO: 311 - protein, 9 aa, Homo sapiens
YTMGLKNAR

SEQ ID NO: 312 - protein, 9 aa, Homo sapiens
STLDCETAR

SEQ ID NO: 313 - protein, 9 aa, Homo sapiens
PVIVTPPTK

SEQ ID NO: 314 - protein, 9 aa, Homo sapiens
VASSCISEK

SEQ ID NO: 315 - protein, 9 aa, Homo sapiens
TPTPPEVTK

SEQ ID NO: 316 - protein, 9 aa, Homo sapiens
PTFCTPGLK

SEQ ID NO: 317 - protein, 9 aa, Homo sapiens
QLSDFGLER

SEQ ID NO: 318 - protein, 9 aa, Homo sapiens
KYGYSPRVK

SEQ ID NO: 319 - protein, 9 aa, Homo sapiens
FQKYGYSPR

SEQ ID NO: 320 - protein, 9 aa, Homo sapiens
MKIREYFQK

SEQ ID NO: 321 - protein, 9 aa, Homo sapiens
KVLMEKNSM

SEQ ID NO: 322 - protein, 9 aa, Homo sapiens
DPIRSFCGK

SEQ ID NO: 323 - protein, 9 aa, Homo sapiens
FLKHGQNIR

SEQ ID NO: 324 - protein, 9 aa, Homo sapiens
QNIRDVSNK

SEQ ID NO: 325 - protein, 9 aa, Homo sapiens
LSNCENFQK

SEQ ID NO: 326 - protein, 9 aa, Homo sapiens
KTPKCALKM

SEQ ID NO: 327 - protein, 9 aa, Homo sapiens
NEDYTMGLK

SEQ ID NO: 328 - protein, 9 aa, Homo sapiens
SCISEKSPR

SEQ ID NO: 329 - protein, 9 aa, Homo sapiens
KVLKTPKCA

SEQ ID NO: 330 - protein, 9 aa, Homo sapiens
PPTKQSLVK

SEQ ID NO: 331 - protein, 9 aa, Homo sapiens
YGYSPRVKK

SEQ ID NO: 332 - protein, 9 aa, Homo sapiens
NVFATPSPI

SEQ ID NO: 333 - protein, 9 aa, Homo sapiens
VSTNYPLSK

SEQ ID NO: 334 - protein, 9 aa, Homo sapiens
LVLNSDTCF

SEQ ID NO: 335 - protein, 9 aa, Homo sapiens
KTNSSSNDL

SEQ ID NO: 336 - protein, 9 aa, Homo sapiens
QVLPNPPQA

SEQ ID NO: 337 - protein, 9 aa, Homo sapiens
GISEYTMCL

SEQ ID NO: 338 - protein, 9 aa, Homo sapiens
DCETARLQR

SEQ ID NO: 339 - protein, 9 aa, Homo sapiens
KIPEDILQL

SEQ ID NO: 340 - protein, 9 aa, Homo sapiens
ENFQKTDVK

SEQ ID NO: 341 - protein, 9 aa, Homo sapiens
LKTPKCALK

SEQ ID NO: 342 - protein, 9 aa, Homo sapiens
CVTPKLEHF

SEQ ID NO: 343 - protein, 9 aa, Homo sapiens
PPQAVNNYK

SEQ ID NO: 344 - protein, 9 aa, Homo sapiens
YTMCLNEDY

SEQ ID NO: 345 - protein, 9 aa, Homo sapiens
LHSEVQTLK

SEQ ID NO: 346 - protein, 9 aa, Homo sapiens
EDILQLLSK

SEQ ID NO: 347 - protein, 9 aa, Homo sapiens
DDVNILLDK

SEQ ID NO: 348 - protein, 9 aa, Homo sapiens
QTLKDDVNI

SEQ ID NO: 349 - protein, 9 aa, Homo sapiens
KLRSLASTL

SEQ ID NO: 350 - protein, 9 aa, Homo sapiens
DDFECVTPK

SEQ ID NO: 351 - protein, 10 aa, Homo sapiens
AVPPSKRFLK

SEQ ID NO: 352 - protein, 10 aa, Homo sapiens
LVSTNYPLSK

SEQ ID NO: 353 - protein, 10 aa, Homo sapiens
RTPTPPEVTK

SEQ ID NO: 354 - protein, 10 aa, Homo sapiens
GQNIRDVSNK

SEQ ID NO: 355 - protein, 10 aa, Homo sapiens
IMKIREYFQK

SEQ ID NO: 356 - protein, 10 aa, Homo sapiens
KYGYSPRVKK

SEQ ID NO: 357 - protein, 10 aa, Homo sapiens
SLVKVLKTPK

SEQ ID NO: 358 - protein, 10 aa, Homo sapiens
VLKTPKCALK

SEQ ID NO: 359 - protein, 10 aa, Homo sapiens
TPPTKQSLVK

SEQ ID NO: 360 - protein, 10 aa, Homo sapiens
ELSNCENFQK

SEQ ID NO: 361 - protein, 10 aa, Homo sapiens
IAIKAVPPSK

SEQ ID NO: 362 - protein, 10 aa, Homo sapiens
TPGLKIPSTK

SEQ ID NO: 363 - protein, 10 aa, Homo sapiens
PVASSCISEK

SEQ ID NO: 364 - protein, 10 aa, Homo sapiens
NPPQAVNNYK

SEQ ID NO: 365 - protein, 10 aa, Homo sapiens
VPTFCTPGLK

SEQ ID NO: 366 - protein, 10 aa, Homo sapiens
RFLKHGQNIR

SEQ ID NO: 367 - protein, 10 aa, Homo sapiens
TISSYENLLR

SEQ ID NO: 368 - protein, 10 aa, Homo sapiens
KDDVNILLDK

SEQ ID NO: 369 - protein, 10 aa, Homo sapiens
DLHSEVQTLK

SEQ ID NO: 370 - protein, 10 aa, Homo sapiens
MEKNSMDIMK

SEQ ID NO: 371 - protein, 10 aa, Homo sapiens
KVLKTPKCAL

SEQ ID NO: 372 - protein, 10 aa, Homo sapiens
EPVIVTPPTK

SEQ ID NO: 373 - protein, 10 aa, Homo sapiens
AIKAVPPSKR

SEQ ID NO: 374 - protein, 10 aa, Homo sapiens
SNLATPIAIK

SEQ ID NO: 375 - protein, 10 aa, Homo sapiens
DVNILLDKAR

SEQ ID NO: 376 - protein, 10 aa, Homo sapiens
CENFQKTDVK

SEQ ID NO: 377 - protein, 10 aa, Homo sapiens
LNEDYTMGLK

SEQ ID NO: 378 - protein, 10 aa, Homo sapiens
NVFATPSPII

SEQ ID NO: 379 - protein, 10 aa, Homo sapiens
IKATKVLMEK

SEQ ID NO: 380 - protein, 10 aa, Homo sapiens
YFQKYGYSPR

SEQ ID NO: 381 - protein, 10 aa, Homo sapiens
PQLSDFGLER

SEQ ID NO: 382 - protein, 10 aa, Homo sapiens
ENQEGIDFIK

SEQ ID NO: 383 - protein, 10 aa, Homo sapiens
MGLKNARNNK

SEQ ID NO: 384 - protein, 10 aa, Homo sapiens
VTPKLEHFGI

SEQ ID NO: 385 - protein, 10 aa, Homo sapiens
QVLPNPPQAV

SEQ ID NO: 386 - protein, 10 aa, Homo sapiens
RLENQEGIDF

SEQ ID NO: 387 - protein, 10 aa, Homo sapiens
DYTMGLKNAR

SEQ ID NO: 388 - protein, 10 aa, Homo sapiens
LVPTFCTPGL

SEQ ID NO: 389 - protein, 10 aa, Homo sapiens
MDDFECVTPK

SEQ ID NO: 390 - protein, 10 aa, Homo sapiens
MDPIRSFCGK

SEQ ID NO: 391 - protein, 10 aa, Homo sapiens
IVTPPTKQSL

SEQ ID NO: 392 - protein, 10 aa, Homo sapiens
AVNNYKEEPV

SEQ ID NO: 393 - protein, 10 aa, Homo sapiens
TKQSLVKVLK

SEQ ID NO: 394 - protein, 10 aa, Homo sapiens
RILYDLHSEV

SEQ ID NO: 395 - protein, 10 aa, Homo sapiens
VLMEKNSMDI

SEQ ID NO: 396 - protein, 10 aa, Homo sapiens
QTLKDDVNIL

SEQ ID NO: 397 - protein, 10 aa, Homo sapiens
STLDCETARL

SEQ ID NO: 398 - protein, 10 aa, Homo sapiens
KNSMDIMKIR

SEQ ID NO: 399 - protein, 10 aa, Homo sapiens
KIPEDILQLL

SEQ ID NO: 400 - protein, 10 aa, Homo sapiens
GIDFIKATKV

SEQ ID NO: 401 - protein, 9 aa, Homo sapiens
DFECVTPKL

SEQ ID NO: 402 - protein, 9 aa, Homo sapiens
DFIKATKVL

SEQ ID NO: 403 - protein, 9 aa, Homo sapiens
SFCGKLRSL

SEQ ID NO: 404 - protein, 9 aa, Homo sapiens
RFLKHGQNI

SEQ ID NO: 405 - protein, 9 aa, Homo sapiens
KTNSSSNDL

SEQ ID NO: 406 - protein, 9 aa, Homo sapiens
KIPEDILQL

SEQ ID NO: 407 - protein, 9 aa, Homo sapiens
IPEDILQLL

SEQ ID NO: 408 - protein, 9 aa, Homo sapiens
KLRSLASTL

SEQ ID NO: 409 - protein, 9 aa, Homo sapiens
DFEDYPMRI

SEQ ID NO: 410 - protein, 9 aa, Homo sapiens
VTPPTKQSL

SEQ ID NO: 411 - protein, 9 aa, Homo sapiens
YPMRILYDL

SEQ ID NO: 412 - protein, 9 aa, Homo sapiens
TPSPIIQQL

SEQ ID NO: 413 - protein, 9 aa, Homo sapiens
NYPLSKTNS

SEQ ID NO: 414 - protein, 9 aa, Homo sapiens
KAVPPSKRF

SEQ ID NO: 415 - protein, 9 aa, Homo sapiens
EAIDTESRL

SEQ ID NO: 416 - protein, 9 aa, Homo sapiens
AVPPSKRFL

SEQ ID NO: 417 - protein, 9 aa, Homo sapiens
LNEDYTMGL

SEQ ID NO: 418 - protein, 9 aa, Homo sapiens
GYSPRVKKN

SEQ ID NO: 419 - protein, 9 aa, Homo sapiens
EAINSDPEL

SEQ ID NO: 420 - protein, 9 aa, Homo sapiens
NILLDKARL

SEQ ID NO: 421 - protein, 9 aa, Homo sapiens
ALVSTNYPL

SEQ ID NO: 422 - protein, 9 aa, Homo sapiens
NYKEEPVIV

SEQ ID NO: 423 - protein, 9 aa, Homo sapiens
SPQLSDFGL

SEQ ID NO: 424 - protein, 9 aa, Homo sapiens
DAEYTNSPL

SEQ ID NO: 425 - protein, 9 aa, Homo sapiens
TLKDDVNIL

SEQ ID NO: 426 - protein, 9 aa, Homo sapiens
TFCTPGLKI

SEQ ID NO: 427 - protein, 9 aa, Homo sapiens
DYTMGLKNA

SEQ ID NO: 428 - protein, 9 aa, Homo sapiens
VFATPSPII

SEQ ID NO: 429 - protein, 9 aa, Homo sapiens
EYFQKYGYS

SEQ ID NO: 430 - protein, 9 aa, Homo sapiens
ETARLQRAL

SEQ ID NO: 431 - protein, 9 aa, Homo sapiens
DLHSEVQTL

SEQ ID NO: 432 - protein, 9 aa, Homo sapiens
NSDTCFENL

SEQ ID NO: 433 - protein, 9 aa, Homo sapiens
TISSYENLL

SEQ ID NO: 434 - protein, 9 aa, Homo sapiens
GISEYTMCL

SEQ ID NO: 435 - protein, 9 aa, Homo sapiens
DIMKIREYF

SEQ ID NO: 436 - protein, 9 aa, Homo sapiens
VPTFCTPGL

SEQ ID NO: 437 - protein, 9 aa, Homo sapiens
VTKIPEDIL

SEQ ID NO: 438 - protein, 9 aa, Homo sapiens
KCALKMDDF

SEQ ID NO: 439 - protein, 9 aa, Homo sapiens
TLDCETARL

SEQ ID NO: 440 - protein, 9 aa, Homo sapiens
LLSKYNSNL

SEQ ID NO: 441 - protein, 9 aa, Homo sapiens
VLKTPKCAL

SEQ ID NO: 442 - protein, 9 aa, Homo sapiens
KIPSTKNSI

SEQ ID NO: 443 - protein, 9 aa, Homo sapiens
RNNKSEEAI

SEQ ID NO: 444 - protein, 9 aa, Homo sapiens
LVLNSDTCF

SEQ ID NO: 445 - protein, 9 aa, Homo sapiens
TNSPLVPTF

SEQ ID NO: 446 - protein, 9 aa, Homo sapiens
HFGISEYTM

SEQ ID NO: 447 - protein, 9 aa, Homo sapiens
CVTPKLEHF

SEQ ID NO: 448 - protein, 9 aa, Homo sapiens
ESRLNDNVF

SEQ ID NO: 449 - protein, 9 aa, Homo sapiens
KNSMDIMKI

SEQ ID NO: 450 - protein, 9 aa, Homo sapiens
ALDGEESDF

SEQ ID NO: 451 - protein, 10 aa, Homo sapiens
DYPMRILYDL

SEQ ID NO: 452 - protein, 10 aa, Homo sapiens
KYNSNLATPI

SEQ ID NO: 453 - protein, 10 aa, Homo sapiens
DFEDYPMRIL

SEQ ID NO: 454 - protein, 10 aa, Homo sapiens
KIPEDILQLL

SEQ ID NO: 455 - protein, 10 aa, Homo sapiens
RYIVSQVLPN

SEQ ID NO: 456 - protein, 10 aa, Homo sapiens
KAVPPSKRFL

SEQ ID NO: 457 - protein, 10 aa, Homo sapiens
RSPQLSDFGL

SEQ ID NO: 458 - protein, 10 aa, Homo sapiens
KVLKTPKCAL

SEQ ID NO: 459 - protein, 10 aa, Homo sapiens
ATPSPIIQQL

SEQ ID NO: 460 - protein, 10 aa, Homo sapiens
NYPLSKTNSS

SEQ ID NO: 461 - protein, 10 aa, Homo sapiens
SYENLLRTPT

SEQ ID NO: 462 - protein, 10 aa, Homo sapiens
GYSPRVKKNS

SEQ ID NO: 463 - protein, 10 aa, Homo sapiens
RSFCGKLRSL

SEQ ID NO: 464 - protein, 10 aa, Homo sapiens
CLNEDYTMGL

SEQ ID NO: 465 - protein, 10 aa, Homo sapiens
QTLKDDVNIL

SEQ ID NO: 466 - protein, 10 aa, Homo sapiens
RALDGEESDF

SEQ ID NO: 467 - protein, 10 aa, Homo sapiens
EVEDRTSLVL

SEQ ID NO: 468 - protein, 10 aa, Homo sapiens
STLDCETARL

SEQ ID NO: 469 - protein, 10 aa, Homo sapiens
TLKDDVNILL

SEQ ID NO: 470 - protein, 10 aa, Homo sapiens
DPIRSFCGKL

SEQ ID NO: 471 - protein, 10 aa, Homo sapiens
NYKEEPVIVT

SEQ ID NO: 472 - protein, 10 aa, Homo sapiens
DLEVEDRTSL

SEQ ID NO: 473 - protein, 10 aa, Homo sapiens
IALVSTNYPL

SEQ ID NO: 474 - protein, 10 aa, Homo sapiens
LVPTFCTPGL

SEQ ID NO: 475 - protein, 10 aa, Homo sapiens
FGISEYTMCL

SEQ ID NO: 476 - protein, 10 aa, Homo sapiens
QLLSKYNSNL

SEQ ID NO: 477 - protein, 10 aa, Homo sapiens
RLENQEGIDF

SEQ ID NO: 478 - protein, 10 aa, Homo sapiens
VNILLDKARL

SEQ ID NO: 479 - protein, 10 aa, Homo sapiens
EYTMCLNEDY

SEQ ID NO: 480 - protein, 10 aa, Homo sapiens
LNSDTCFENL

SEQ ID NO: 481 - protein, 10 aa, Homo sapiens
IVTPPTKQSL

SEQ ID NO: 482 - protein, 10 aa, Homo sapiens
FQKTDVKDDL

SEQ ID NO: 483 - protein, 10 aa, Homo sapiens
LYDLHSEVQT

SEQ ID NO: 484 - protein, 10 aa, Homo sapiens
EYTNSPLVPT

SEQ ID NO: 485 - protein, 10 aa, Homo sapiens
EVTKIPEDIL

SEQ ID NO: 486 - protein, 10 aa, Homo sapiens
IPSTKNSIAL

SEQ ID NO: 487 - protein, 10 aa, Homo sapiens
SPTISSYENL

SEQ ID NO: 488 - protein, 10 aa, Homo sapiens
DFIKATKVLM

SEQ ID NO: 489 - protein, 10 aa, Homo sapiens
YTNSPLVPTF

SEQ ID NO: 490 - protein, 10 aa, Homo sapiens
SLVLNSDTCF

SEQ ID NO: 491 - protein, 10 aa, Homo sapiens
ECVTPKLEHF

SEQ ID NO: 492 - protein, 10 aa, Homo sapiens
DPELSNCENF

SEQ ID NO: 493 - protein, 10 aa, Homo sapiens
KARLENQEGI

SEQ ID NO: 494 - protein, 10 aa, Homo sapiens
KNSVHEQEAI

SEQ ID NO: 495 - protein, 10 aa, Homo sapiens
SPRSPQLSDF

SEQ ID NO: 496 - protein, 10 aa, Homo sapiens
VLMEKNSMDI

SEQ ID NO: 497 - protein, 10 aa, Homo sapiens
VTPKLEHFGI

SEQ ID NO: 498 - protein, 10 aa, Homo sapiens
DNVFATPSPI

SEQ ID NO: 499 - protein, 10 aa, Homo sapiens
VNNYKEEPVI

SEQ ID NO: 500 - protein, 10 aa, Homo sapiens
NSNLATPIAI

SEQ ID NO: 501 - protein, 9 aa, Homo sapiens
YPMRILYDL

SEQ ID NO: 502 - protein, 9 aa, Homo sapiens
TPSPIIQQL

SEQ ID NO: 503 - protein, 9 aa, Homo sapiens
SPQLSDFGL

SEQ ID NO: 504 - protein, 9 aa, Homo sapiens
VPTFCTPGL

SEQ ID NO: 505 - protein, 9 aa, Homo sapiens
AVPPSKRFL

SEQ ID NO: 506 - protein, 9 aa, Homo sapiens
SPRVKKNSV

SEQ ID NO: 507 - protein, 9 aa, Homo sapiens
KLRSLASTL

SEQ ID NO: 508 - protein, 9 aa, Homo sapiens
IPEDILQLL

SEQ ID NO: 509 - protein, 9 aa, Homo sapiens
ALVSTNYPL

SEQ ID NO: 510 - protein, 9 aa, Homo sapiens
EAIDTESRL

SEQ ID NO: 511 - protein, 9 aa, Homo sapiens
EAINSDPEL

SEQ ID NO: 512 - protein, 9 aa, Homo sapiens
TPKLEHFGI

SEQ ID NO: 513 - protein, 9 aa, Homo sapiens
DPPVASSCI

SEQ ID NO: 514 - protein, 9 aa, Homo sapiens
VTKIPEDIL

SEQ ID NO: 515 - protein, 9 aa, Homo sapiens
VLKTPKCAL

SEQ ID NO: 516 - protein, 9 aa, Homo sapiens
KVLMEKNSM

SEQ ID NO: 517 - protein, 9 aa, Homo sapiens
LLSKYNSNL

SEQ ID NO: 518 - protein, 9 aa, Homo sapiens
VTPPTKQSL

SEQ ID NO: 519 - protein, 9 aa, Homo sapiens
PIRSFCGKL

SEQ ID NO: 520 - protein, 9 aa, Homo sapiens
ETARLQRAL

SEQ ID NO: 521 - protein, 9 aa, Homo sapiens
KTNSSSNDL

SEQ ID NO: 522 - protein, 9 aa, Homo sapiens
KIPEDILQL

SEQ ID NO: 523 - protein, 9 aa, Homo sapiens
NILLDKARL

SEQ ID NO: 524 - protein, 9 aa, Homo sapiens
GISEYTMCL

SEQ ID NO: 525 - protein, 9 aa, Homo sapiens
TISSYENLL

SEQ ID NO: 526 - protein, 9 aa, Homo sapiens
DLHSEVQTL

SEQ ID NO: 527 - protein, 9 aa, Homo sapiens
TPPTKQSLV

SEQ ID NO: 528 - protein, 9 aa, Homo sapiens
TLKDDVNIL

SEQ ID NO: 529 - protein, 9 aa, Homo sapiens
DAEYTNSPL

SEQ ID NO: 530 - protein, 9 aa, Homo sapiens
SPRSPQLSD

SEQ ID NO: 531 - protein, 9 aa, Homo sapiens
SPLVPTFCT

SEQ ID NO: 532 - protein, 9 aa, Homo sapiens
EPVIVTPPT

SEQ ID NO: 533 - protein, 9 aa, Homo sapiens
EVTKIPEDI

SEQ ID NO: 534 - protein, 9 aa, Homo sapiens
NVFATPSPI

SEQ ID NO: 535 - protein, 9 aa, Homo sapiens
IPSTKNSIA

SEQ ID NO: 536 - protein, 9 aa, Homo sapiens
TPGLKIPST

SEQ ID NO: 537 - protein, 9 aa, Homo sapiens
LNEDYTMGL

SEQ ID NO: 538 - protein, 9 aa, Homo sapiens
TLDCETARL

SEQ ID NO: 539 - protein, 9 aa, Homo sapiens
NSDTCFENL

SEQ ID NO: 540 - protein, 9 aa, Homo sapiens
FIKATKVLM

SEQ ID NO: 541 - protein, 9 aa, Homo sapiens
KTPKCALKM

SEQ ID NO: 542 - protein, 9 aa, Homo sapiens
MCLNEDYTM

SEQ ID NO: 543 - protein, 9 aa, Homo sapiens
EVQTLKDDV

SEQ ID NO: 544 - protein, 9 aa, Homo sapiens
LPNPPQAVN

SEQ ID NO: 545 - protein, 9 aa, Homo sapiens
ATPIAIKAV

SEQ ID NO: 546 - protein, 9 aa, Homo sapiens
DPSSPTISS

SEQ ID NO: 547 - protein, 9 aa, Homo sapiens
LEVEDRTSL

SEQ ID NO: 548 - protein, 9 aa, Homo sapiens
KVLKTPKCA

SEQ ID NO: 549 - protein, 9 aa, Homo sapiens
DVNILLDKA

SEQ ID NO: 550 - protein, 9 aa, Homo sapiens
QVLPNPPQA

SEQ ID NO: 551 - protein, 10 aa, Homo sapiens
SPTISSYENL

SEQ ID NO: 552 - protein, 10 aa, Homo sapiens
IPSTKNSIAL

SEQ ID NO: 553 - protein, 10 aa, Homo sapiens
DPIRSFCGKL

SEQ ID NO: 554 - protein, 10 aa, Homo sapiens
KVLKTPKCAL

SEQ ID NO: 555 - protein, 10 aa, Homo sapiens
EVTKIPEDIL

SEQ ID NO: 556 - protein, 10 aa, Homo sapiens
IVTPPTKQSL

SEQ ID NO: 557 - protein, 10 aa, Homo sapiens
LVPTFCTPGL

SEQ ID NO: 558 - protein, 10 aa, Homo sapiens
KAVPPSKRFL

SEQ ID NO: 559 - protein, 10 aa, Homo sapiens
KARLENQEGI

SEQ ID NO: 560 - protein, 10 aa, Homo sapiens
ATPSPIIQQL

SEQ ID NO: 561 - protein, 10 aa, Homo sapiens
IALVSTNYPL

SEQ ID NO: 562 - protein, 10 aa, Homo sapiens
TPTPPEVTKI

SEQ ID NO: 563 - protein, 10 aa, Homo sapiens
EVEDRTSLVL

SEQ ID NO: 564 - protein, 10 aa, Homo sapiens
SPRSPQLSDF

SEQ ID NO: 565 - protein, 10 aa, Homo sapiens
QLLSKYNSNL

SEQ ID NO: 566 - protein, 10 aa, Homo sapiens
RSFCGKLRSL

SEQ ID NO: 567 - protein, 10 aa, Homo sapiens
TLKDDVNILL

SEQ ID NO: 568 - protein, 10 aa, Homo sapiens
STLDCETARL

SEQ ID NO: 569 - protein, 10 aa, Homo sapiens
LNSDTCFENL

SEQ ID NO: 570 - protein, 10 aa, Homo sapiens
FQKTDVKDDL

SEQ ID NO: 571 - protein, 10 aa, Homo sapiens
CLNEDYTMGL

SEQ ID NO: 572 - protein, 10 aa, Homo sapiens
KIPEDILQLL

SEQ ID NO: 573 - protein, 10 aa, Homo sapiens
VNILLDKARL

SEQ ID NO: 574 - protein, 10 aa, Homo sapiens
LERYIVSQVL

SEQ ID NO: 575 - protein, 10 aa, Homo sapiens
QTLKDDVNIL

SEQ ID NO: 576 - protein, 10 aa, Homo sapiens
RSPQLSDFGL

SEQ ID NO: 577 - protein, 10 aa, Homo sapiens
FGISEYTMCL

SEQ ID NO: 578 - protein, 10 aa, Homo sapiens
NVFATPSPII

SEQ ID NO: 579 - protein, 10 aa, Homo sapiens
NARNNKSEEA

SEQ ID NO: 580 - protein, 10 aa, Homo sapiens
AVNNYKEEPV

SEQ ID NO: 581 - protein, 10 aa, Homo sapiens
SPRVKKNSVH

SEQ ID NO: 582 - protein, 10 aa, Homo sapiens
LLRTPTPPEV

SEQ ID NO: 583 - protein, 10 aa, Homo sapiens
DLEVEDRTSL

SEQ ID NO: 584 - protein, 10 aa, Homo sapiens
QVLPNPPQAV

SEQ ID NO: 585 - protein, 10 aa, Homo sapiens
VLMEKNSMDI

SEQ ID NO: 586 - protein, 10 aa, Homo sapiens
ESRLNDNVFA

SEQ ID NO: 587 - protein, 10 aa, Homo sapiens
TMCLNEDYTM

SEQ ID NO: 588 - protein, 10 aa, Homo sapiens
YPMRILYDLH

SEQ ID NO: 589 - protein, 10 aa, Homo sapiens
LATPIAIKAV

SEQ ID NO: 590 - protein, 10 aa, Homo sapiens
ALKMDDFECV

SEQ ID NO: 591 - protein, 10 aa, Homo sapiens
LVKVLKTPKC

SEQ ID NO: 592 - protein, 10 aa, Homo sapiens
NSNLATPIAI

SEQ ID NO: 593 - protein, 10 aa, Homo sapiens
DPSSPTISSY

SEQ ID NO: 594 - protein, 10 aa, Homo sapiens
SEKSPRSPQL

SEQ ID NO: 595 - protein, 10 aa, Homo sapiens
PTKQSLVKVL

SEQ ID NO: 596 - protein, 10 aa, Homo sapiens
PPTKQSLVKV

SEQ ID NO: 597 - protein, 10 aa, Homo sapiens
VQTLKDDVNI

SEQ ID NO: 598 - protein, 10 aa, Homo sapiens
SPIIQQLEKS

SEQ ID NO: 599 - protein, 10 aa, Homo sapiens
TKIPEDILQL

SEQ ID NO: 600 - protein, 10 aa, Homo sapiens
EEAIDTESRL

SEQ ID NO: 601 - protein, 9 aa, Homo sapiens
NPPQAVNNY

SEQ ID NO: 602 - protein, 9 aa, Homo sapiens
TPKLEHFGI

SEQ ID NO: 603 - protein, 9 aa, Homo sapiens
KIREYFQKY

SEQ ID NO: 604 - protein, 9 aa, Homo sapiens
VPTFCTPGL

SEQ ID NO: 605 - protein, 9 aa, Homo sapiens
TPSPIIQQL

SEQ ID NO: 606 - protein, 9 aa, Homo sapiens
YPMRILYDL

SEQ ID NO: 607 - protein, 9 aa, Homo sapiens
SPQLSDFGL

SEQ ID NO: 608 - protein, 9 aa, Homo sapiens
ESRLNDNVF

SEQ ID NO: 609 - protein, 9 aa, Homo sapiens
SPRVKKNSV

SEQ ID NO: 610 - protein, 9 aa, Homo sapiens
IPEDILQLL

SEQ ID NO: 611 - protein, 9 aa, Homo sapiens
TLKDDVNIL

SEQ ID NO: 612 - protein, 9 aa, Homo sapiens
DPPVASSCI

SEQ ID NO: 613 - protein, 9 aa, Homo sapiens
KIPEDILQL

SEQ ID NO: 614 - protein, 9 aa, Homo sapiens
FIKATKVLM

SEQ ID NO: 615 - protein, 9 aa, Homo sapiens
EAIDTESRL

SEQ ID NO: 616 - protein, 9 aa, Homo sapiens
KVLMEKNSM

SEQ ID NO: 617 - protein, 9 aa, Homo sapiens
KLRSLASTL

SEQ ID NO: 618 - protein, 9 aa, Homo sapiens
KAVPPSKRF

SEQ ID NO: 619 - protein, 9 aa, Homo sapiens
ESDFEDYPM

SEQ ID NO: 620 - protein, 9 aa, Homo sapiens
KTPKCALKM

SEQ ID NO: 621 - protein, 9 aa, Homo sapiens
TPPTKQSLV

SEQ ID NO: 622 - protein, 9 aa, Homo sapiens
MCLNEDYTM

SEQ ID NO: 623 - protein, 9 aa, Homo sapiens
LSDFGLERY

SEQ ID NO: 624 - protein, 9 aa, Homo sapiens
VLKTPKCAL

SEQ ID NO: 625 - protein, 9 aa, Homo sapiens
EAINSDPEL

SEQ ID NO: 626 - protein, 9 aa, Homo sapiens
VTKIPEDIL

SEQ ID NO: 627 - protein, 9 aa, Homo sapiens
NSVHEQEAI

SEQ ID NO: 628 - protein, 9 aa, Homo sapiens
EPVIVTPPT

SEQ ID NO: 629 - protein, 9 aa, Homo sapiens
KCALKMDDF

SEQ ID NO: 630 - protein, 9 aa, Homo sapiens
IPSTKNSIA

SEQ ID NO: 631 - protein, 9 aa, Homo sapiens
SIALVSTNY

SEQ ID NO: 632 - protein, 9 aa, Homo sapiens
DILQLLSKY

SEQ ID NO: 633 - protein, 9 aa, Homo sapiens
SPLVPTFCT

SEQ ID NO: 634 - protein, 9 aa, Homo sapiens
GISEYTMCL

SEQ ID NO: 635 - protein, 9 aa, Homo sapiens
YPLSKTNSS

SEQ ID NO: 636 - protein, 9 aa, Homo sapiens
KTNSSSNDL

SEQ ID NO: 637 - protein, 9 aa, Homo sapiens
SPTISSYEN

SEQ ID NO: 638 - protein, 9 aa, Homo sapiens
DPSSPTISS

SEQ ID NO: 639 - protein, 9 aa, Homo sapiens
TPGLKIPST

SEQ ID NO: 640 - protein, 9 aa, Homo sapiens
YTMCLNEDY

SEQ ID NO: 641 - protein, 9 aa, Homo sapiens
LPNPPQAVN

SEQ ID NO: 642 - protein, 9 aa, Homo sapiens
LSKYNSNLA

SEQ ID NO: 643 - protein, 9 aa, Homo sapiens
NSDTCFENL

SEQ ID NO: 644 - protein, 9 aa, Homo sapiens
LSKTNSSSN

SEQ ID NO: 645 - protein, 9 aa, Homo sapiens
DLHSEVQTL

SEQ ID NO: 646 - protein, 9 aa, Homo sapiens
NILLDKARL

SEQ ID NO: 647 - protein, 9 aa, Homo sapiens
KNSMDIMKI

SEQ ID NO: 648 - protein, 9 aa, Homo sapiens
ALVSTNYPL

SEQ ID NO: 649 - protein, 9 aa, Homo sapiens
DIMKIREYF

SEQ ID NO: 650 - protein, 9 aa, Homo sapiens
VTPPTKQSL

SEQ ID NO: 651 - protein, 10 aa, Homo sapiens
SPRSPQLSDF

SEQ ID NO: 652 - protein, 10 aa, Homo sapiens
DPSSPTISSY

SEQ ID NO: 653 - protein, 10 aa, Homo sapiens
SPTISSYENL

SEQ ID NO: 654 - protein, 10 aa, Homo sapiens
DPIRSFCGKL

SEQ ID NO: 655 - protein, 10 aa, Homo sapiens
IPSTKNSIAL

SEQ ID NO: 656 - protein, 10 aa, Homo sapiens
RALDGEESDF

SEQ ID NO: 657 - protein, 10 aa, Homo sapiens
TPTPPEVTKI

SEQ ID NO: 658 - protein, 10 aa, Homo sapiens
NSIALVSTNY

SEQ ID NO: 659 - protein, 10 aa, Homo sapiens
RSPQLSDFGL

SEQ ID NO: 660 - protein, 10 aa, Homo sapiens
RSFCGKLRSL

SEQ ID NO: 661 - protein, 10 aa, Homo sapiens
KARLENQEGI

SEQ ID NO: 662 - protein, 10 aa, Homo sapiens
KAVPPSKRFL

SEQ ID NO: 663 - protein, 10 aa, Homo sapiens
TLKDDVNILL

SEQ ID NO: 664 - protein, 10 aa, Homo sapiens
TPKLEHFGIS

SEQ ID NO: 665 - protein, 10 aa, Homo sapiens
DPELSNCENF

SEQ ID NO: 666 - protein, 10 aa, Homo sapiens
QLSDFGLERY

SEQ ID NO: 667 - protein, 10 aa, Homo sapiens
KIPEDILQLL

SEQ ID NO: 668 - protein, 10 aa, Homo sapiens
QQLEKSDAEY

SEQ ID NO: 669 - protein, 10 aa, Homo sapiens
IALVSTNYPL

SEQ ID NO: 670 - protein, 10 aa, Homo sapiens
STLDCETARL

SEQ ID NO: 671 - protein, 10 aa, Homo sapiens
TMCLNEDYTM

SEQ ID NO: 672 - protein, 10 aa, Homo sapiens
FQKTDVKDDL

SEQ ID NO: 673 - protein, 10 aa, Homo sapiens
ESRLNDNVFA

SEQ ID NO: 674 - protein, 10 aa, Homo sapiens
SPIIQQLEKS

SEQ ID NO: 675 - protein, 10 aa, Homo sapiens
LNSDTCFENL

SEQ ID NO: 676 - protein, 10 aa, Homo sapiens
DPPVASSCIS

SEQ ID NO: 677 - protein, 10 aa, Homo sapiens
CLNEDYTMGL

SEQ ID NO: 678 - protein, 10 aa, Homo sapiens
LPNPPQAVNN

SEQ ID NO: 679 - protein, 10 aa, Homo sapiens
KVLKTPKCAL

SEQ ID NO: 680 - protein, 10 aa, Homo sapiens
YPLSKTNSSS

SEQ ID NO: 681 - protein, 10 aa, Homo sapiens
NSNLATPIAI

SEQ ID NO: 682 - protein, 10 aa, Homo sapiens
DGEESDFEDY

SEQ ID NO: 683 - protein, 10 aa, Homo sapiens
VNILLDKARL

SEQ ID NO: 684 - protein, 10 aa, Homo sapiens
LSKYNSNLAT

SEQ ID NO: 685 - protein, 10 aa, Homo sapiens
QTLKDDVNIL

SEQ ID NO: 686 - protein, 10 aa, Homo sapiens
KLEHFGISEY

SEQ ID NO: 687 - protein, 10 aa, Homo sapiens
IPEDILQLLS

SEQ ID NO: 688 - protein, 10 aa, Homo sapiens
KNSVHEQEAI

SEQ ID NO: 689 - protein, 10 aa, Homo sapiens
SLVLNSDTCF

SEQ ID NO: 690 - protein, 10 aa, Homo sapiens
ATPSPIIQQL

SEQ ID NO: 691 - protein, 10 aa, Homo sapiens
YSPRVKKNSV

SEQ ID NO: 692 - protein, 10 aa, Homo sapiens
QLLSKYNSNL

SEQ ID NO: 693 - protein, 10 aa, Homo sapiens
LVPTFCTPGL

SEQ ID NO: 694 - protein, 10 aa, Homo sapiens
YTNSPLVPTF

SEQ ID NO: 695 - protein, 10 aa, Homo sapiens
FGISEYTMCL

SEQ ID NO: 696 - protein, 10 aa, Homo sapiens
IVTPPTKQSL

SEQ ID NO: 697 - protein, 10 aa, Homo sapiens
EVTKIPEDIL

SEQ ID NO: 698 - protein, 10 aa, Homo sapiens
ECVTPKLEHF

SEQ ID NO: 699 - protein, 10 aa, Homo sapiens
RLENQEGIDF

SEQ ID NO: 700 - protein, 10 aa, Homo sapiens
NARNNKSEEA

SEQ ID NO: 701 - protein, 9 aa, Homo sapiens
VASSCISGK

SEQ ID NO: 702 - protein, 9 aa, Homo sapiens
SCISGKSPR

SEQ ID NO: 703 - protein, 9 aa, Homo sapiens
CISGKSPRS

SEQ ID NO: 704 - protein, 9 aa, Homo sapiens
ASSCISGKS

SEQ ID NO: 705 - protein, 9 aa, Homo sapiens
GKSPRSPQL

SEQ ID NO: 706 - protein, 9 aa, Homo sapiens
PVASSCISG

SEQ ID NO: 707 - protein, 9 aa, Homo sapiens
SSCISGKSP

SEQ ID NO: 708 - protein, 9 aa, Homo sapiens
SGKSPRSPQ

SEQ ID NO: 709 - protein, 9 aa, Homo sapiens
ISGKSPRSP

SEQ ID NO: 710 - protein, 10 aa, Homo sapiens
SSCISGKSPR

SEQ ID NO: 711 - protein, 10 aa, Homo sapiens
SCISGKSPRS

SEQ ID NO: 712 - protein, 10 aa, Homo sapiens
PVASSCISGK

SEQ ID NO: 713 - protein, 10 aa, Homo sapiens
VASSCISGKS

SEQ ID NO: 714 - protein, 10 aa, Homo sapiens
GKSPRSPQLS

SEQ ID NO: 715 - protein, 10 aa, Homo sapiens
ISGKSPRSPQ

SEQ ID NO: 716 - protein, 10 aa, Homo sapiens
ASSCISGKSP

SEQ ID NO: 717 - protein, 10 aa, Homo sapiens
PPVASSCISG

SEQ ID NO: 718 - protein, 10 aa, Homo sapiens
CISGKSPRSP

SEQ ID NO: 719 - protein, 10 aa, Homo sapiens
SGKSPRSPQL

SEQ ID NO: 720 - protein, 9 aa, Homo sapiens
GKSPRSPQL

SEQ ID NO: 721 - protein, 9 aa, Homo sapiens
CISGKSPRS

SEQ ID NO: 722 - protein, 9 aa, Homo sapiens
VASSCISGK

SEQ ID NO: 723 - protein, 9 aa, Homo sapiens
PVASSCISG

SEQ ID NO: 724 - protein, 9 aa, Homo sapiens
SCISGKSPR

SEQ ID NO: 725 - protein, 9 aa, Homo sapiens
SSCISGKSP

SEQ ID NO: 726 - protein, 9 aa, Homo sapiens
ASSCISGKS

SEQ ID NO: 727 - protein, 9 aa, Homo sapiens
ISGKSPRSP

SEQ ID NO: 728 - protein, 9 aa, Homo sapiens
SGKSPRSPQ

SEQ ID NO: 729 - protein, 10 aa, Homo sapiens
SGKSPRSPQL

SEQ ID NO: 730 - protein, 10 aa, Homo sapiens
SCISGKSPRS

SEQ ID NO: 731 - protein, 10 aa, Homo sapiens
CISGKSPRSP

SEQ ID NO: 732 - protein, 10 aa, Homo sapiens
VASSCISGKS

SEQ ID NO: 733 - protein, 10 aa, Homo sapiens
ISGKSPRSPQ

SEQ ID NO: 734 - protein, 10 aa, Homo sapiens
GKSPRSPQLS

SEQ ID NO: 735 - protein, 10 aa, Homo sapiens
ASSCISGKSP

SEQ ID NO: 736 - protein, 10 aa, Homo sapiens
SSCISGKSPR

SEQ ID NO: 737 - protein, 10 aa, Homo sapiens
PVASSCISGK

SEQ ID NO: 738 - protein, 10 aa, Homo sapiens
PPVASSCISG

SEQ ID NO: 739 - protein, 9 aa, Homo sapiens
VASSCISGK

SEQ ID NO: 740 - protein, 9 aa, Homo sapiens
SCISGKSPR

SEQ ID NO: 741 - protein, 9 aa, Homo sapiens
CISGKSPRS

SEQ ID NO: 742 - protein, 9 aa, Homo sapiens
GKSPRSPQL

SEQ ID NO: 743 - protein, 9 aa, Homo sapiens
PVASSCISG

SEQ ID NO: 744 - protein, 9 aa, Homo sapiens
ASSCISGKS

SEQ ID NO: 745 - protein, 9 aa, Homo sapiens
SSCISGKSP

SEQ ID NO: 746 - protein, 9 aa, Homo sapiens
SGKSPRSPQ

SEQ ID NO: 747 - protein, 9 aa, Homo sapiens
ISGKSPRSP

SEQ ID NO: 748 - protein, 10 aa, Homo sapiens
PVASSCISGK

SEQ ID NO: 749 - protein, 10 aa, Homo sapiens
SSCISGKSPR

SEQ ID NO: 750 - protein, 10 aa, Homo sapiens
SGKSPRSPQL

SEQ ID NO: 751 - protein, 10 aa, Homo sapiens
SCISGKSPRS

SEQ ID NO: 752 - protein, 10 aa, Homo sapiens
CISGKSPRSP

SEQ ID NO: 753 - protein, 10 aa, Homo sapiens
GKSPRSPQLS

SEQ ID NO: 754 - protein, 10 aa, Homo sapiens
VASSCISGKS

SEQ ID NO: 755 - protein, 10 aa, Homo sapiens
ISGKSPRSPQ

SEQ ID NO: 756 - protein, 10 aa, Homo sapiens
PPVASSCISG

SEQ ID NO: 757 - protein, 10 aa, Homo sapiens
ASSCISGKSP

SEQ ID NO: 758 - protein, 9 aa, Homo sapiens
VASSCISGK

SEQ ID NO: 759 - protein, 9 aa, Homo sapiens
SCISGKSPR

SEQ ID NO: 760 - protein, 9 aa, Homo sapiens
GKSPRSPQL

SEQ ID NO: 761 - protein, 9 aa, Homo sapiens
CISGKSPRS

SEQ ID NO: 762 - protein, 9 aa, Homo sapiens
PVASSCISG

SEQ ID NO: 763 - protein, 9 aa, Homo sapiens
ASSCISGKS

SEQ ID NO: 764 - protein, 9 aa, Homo sapiens
SGKSPRSPQ

SEQ ID NO: 765 - protein, 9 aa, Homo sapiens
SSCISGKSP

SEQ ID NO: 766 - protein, 9 aa, Homo sapiens
ISGKSPRSP

SEQ ID NO: 767 - protein, 10 aa, Homo sapiens
PVASSCISGK

SEQ ID NO: 768 - protein, 10 aa, Homo sapiens
SSCISGKSPR

SEQ ID NO: 769 - protein, 10 aa, Homo sapiens
SCISGKSPRS

SEQ ID NO: 770 - protein, 10 aa, Homo sapiens
SGKSPRSPQL

SEQ ID NO: 771 - protein, 10 aa, Homo sapiens
VASSCISGKS

SEQ ID NO: 772 - protein, 10 aa, Homo sapiens
PPVASSCISG

SEQ ID NO: 773 - protein, 10 aa, Homo sapiens
GKSPRSPQLS

SEQ ID NO: 774 - protein, 10 aa, Homo sapiens
CISGKSPRSP

SEQ ID NO: 775 - protein, 10 aa, Homo sapiens
ISGKSPRSPQ

SEQ ID NO: 776 - protein, 10 aa, Homo sapiens
ASSCISGKSP

SEQ ID NO: 777 - protein, 9 aa, Homo sapiens
GKSPRSPQL

SEQ ID NO: 778 - protein, 9 aa, Homo sapiens
ASSCISGKS

SEQ ID NO: 779 - protein, 9 aa, Homo sapiens
CISGKSPRS

SEQ ID NO: 780 - protein, 9 aa, Homo sapiens
SCISGKSPR

SEQ ID NO: 781 - protein, 9 aa, Homo sapiens
ISGKSPRSP

SEQ ID NO: 782 - protein, 9 aa, Homo sapiens
SSCISGKSP

SEQ ID NO: 783 - protein, 9 aa, Homo sapiens
SGKSPRSPQ

SEQ ID NO: 784 - protein, 9 aa, Homo sapiens
VASSCISGK

SEQ ID NO: 785 - protein, 9 aa, Homo sapiens
PVASSCISG

SEQ ID NO: 786 - protein, 10 aa, Homo sapiens
SGKSPRSPQL

SEQ ID NO: 787 - protein, 10 aa, Homo sapiens
VASSCISGKS

SEQ ID NO: 788 - protein, 10 aa, Homo sapiens
SCISGKSPRS

SEQ ID NO: 789 - protein, 10 aa, Homo sapiens
GKSPRSPQLS

SEQ ID NO: 790 - protein, 10 aa, Homo sapiens
CISGKSPRSP

SEQ ID NO: 791 - protein, 10 aa, Homo sapiens
ISGKSPRSPQ

SEQ ID NO: 792 - protein, 10 aa, Homo sapiens
ASSCISGKSP

SEQ ID NO: 793 - protein, 10 aa, Homo sapiens
SSCISGKSPR

SEQ ID NO: 794 - protein, 10 aa, Homo sapiens
PPVASSCISG

SEQ ID NO: 795 - protein, 10 aa, Homo sapiens
PVASSCISGK

SEQ ID NO: 796 - protein, 9 aa, Homo sapiens
GKSPRSPQL

SEQ ID NO: 797 - protein, 9 aa, Homo sapiens
ASSCISGKS

SEQ ID NO: 798 - protein, 9 aa, Homo sapiens
VASSCISGK

SEQ ID NO: 799 - protein, 9 aa, Homo sapiens
SGKSPRSPQ

SEQ ID NO: 800 - protein, 9 aa, Homo sapiens
CISGKSPRS

SEQ ID NO: 801 - protein, 9 aa, Homo sapiens
SSCISGKSP

SEQ ID NO: 802 - protein, 9 aa, Homo sapiens
ISGKSPRSP

SEQ ID NO: 803 - protein, 9 aa, Homo sapiens
SCISGKSPR

SEQ ID NO: 804 - protein, 9 aa, Homo sapiens
PVASSCISG

SEQ ID NO: 805 - protein, 10 aa, Homo sapiens
SGKSPRSPQL

SEQ ID NO: 806 - protein, 10 aa, Homo sapiens
VASSCISGKS

SEQ ID NO: 807 - protein, 10 aa, Homo sapiens
ASSCISGKSP

SEQ ID NO: 808 - protein, 10 aa, Homo sapiens
ISGKSPRSPQ

SEQ ID NO: 809 - protein, 10 aa, Homo sapiens
SCISGKSPRS

SEQ ID NO: 810 - protein, 10 aa, Homo sapiens
PPVASSCISG

SEQ ID NO: 811 - protein, 10 aa, Homo sapiens
CISGKSPRSP

SEQ ID NO: 812 - protein, 10 aa, Homo sapiens
SSCISGKSPR

SEQ ID NO: 813 - protein, 10 aa, Homo sapiens
PVASSCISGK

SEQ ID NO: 814 - protein, 10 aa, Homo sapiens
GKSPRSPQLS

SEQ ID NO: 815 - protein, 9 aa, Homo sapiens
ASSCISGKS

SEQ ID NO: 816 - protein, 9 aa, Homo sapiens
GKSPRSPQL

SEQ ID NO: 817 - protein, 9 aa, Homo sapiens
CISGKSPRS

SEQ ID NO: 818 - protein, 9 aa, Homo sapiens
ISGKSPRSP

SEQ ID NO: 819 - protein, 9 aa, Homo sapiens
SSCISGKSP

SEQ ID NO: 820 - protein, 9 aa, Homo sapiens
VASSCISGK

SEQ ID NO: 821 - protein, 9 aa, Homo sapiens
SGKSPRSPQ

SEQ ID NO: 822 - protein, 9 aa, Homo sapiens
SCISGKSPR

SEQ ID NO: 823 - protein, 9 aa, Homo sapiens
PVASSCISG

SEQ ID NO: 824 - protein, 10 aa, Homo sapiens
SGKSPRSPQL

SEQ ID NO: 825 - protein, 10 aa, Homo sapiens
VASSCISGKS

SEQ ID NO: 826 - protein, 10 aa, Homo sapiens
SCISGKSPRS

SEQ ID NO: 827 - protein, 10 aa, Homo sapiens
ISGKSPRSPQ

SEQ ID NO: 828 - protein, 10 aa, Homo sapiens
SSCISGKSPR

SEQ ID NO: 829 - protein, 10 aa, Homo sapiens
ASSCISGKSP

SEQ ID NO: 830 - protein, 10 aa, Homo sapiens
PPVASSCISG

SEQ ID NO: 831 - protein, 10 aa, Homo sapiens
GKSPRSPQLS

SEQ ID NO: 832 - protein, 10 aa, Homo sapiens
CISGKSPRSP

SEQ ID NO: 833 - protein, 10 aa, Homo sapiens
PVASSCISGK

SEQ ID NO: 834 - protein, 9 aa, Homo sapiens
DAESRLNDN

SEQ ID NO: 835 - protein, 9 aa, Homo sapiens
AIDAESRLN

SEQ ID NO: 836 - protein, 9 aa, Homo sapiens
KSEEAIDAE

SEQ ID NO: 837 - protein, 9 aa, Homo sapiens
SEEAIDAES

SEQ ID NO: 838 - protein, 9 aa, Homo sapiens
EAIDAESRL

SEQ ID NO: 839 - protein, 9 aa, Homo sapiens
EEAIDAESR

SEQ ID NO: 840 - protein, 9 aa, Homo sapiens
NKSEEAIDA

SEQ ID NO: 841 - protein, 9 aa, Homo sapiens
IDAESRLND

SEQ ID NO: 842 - protein, 9 aa, Homo sapiens
AESRLNDNV

SEQ ID NO: 843 - protein, 10 aa, Homo sapiens
KSEEAIDAES

SEQ ID NO: 844 - protein, 10 aa, Homo sapiens
DAESRLNDNV

SEQ ID NO: 845 - protein, 10 aa, Homo sapiens
SEEAIDAESR

SEQ ID NO: 846 - protein, 10 aa, Homo sapiens
AIDAESRLND

SEQ ID NO: 847 - protein, 10 aa, Homo sapiens
EAIDAESRLN

SEQ ID NO: 848 - protein, 10 aa, Homo sapiens
NNKSEEAIDA

SEQ ID NO: 849 - protein, 10 aa, Homo sapiens
IDAESRLNDN

SEQ ID NO: 850 - protein, 10 aa, Homo sapiens
EEAIDAESRL

SEQ ID NO: 851 - protein, 10 aa, Homo sapiens
NKSEEAIDAE

SEQ ID NO: 852 - protein, 9 aa, Homo sapiens
AESRLNDNV

SEQ ID NO: 853 - protein, 9 aa, Homo sapiens
EAIDAESRL

SEQ ID NO: 854 - protein, 9 aa, Homo sapiens
NKSEEAIDA

SEQ ID NO: 855 - protein, 9 aa, Homo sapiens
AIDAESRLN

SEQ ID NO: 856 - protein, 9 aa, Homo sapiens
IDAESRLND

SEQ ID NO: 857 - protein, 9 aa, Homo sapiens
KSEEAIDAE

SEQ ID NO: 858 - protein, 9 aa, Homo sapiens
SEEAIDAES

SEQ ID NO: 859 - protein, 9 aa, Homo sapiens
DAESRLNDN

SEQ ID NO: 860 - protein, 9 aa, Homo sapiens
EEAIDAESR

SEQ ID NO: 861 - protein, 10 aa, Homo sapiens
EEAIDAESRL

SEQ ID NO: 862 - protein, 10 aa, Homo sapiens
DAESRLNDNV

SEQ ID NO: 863 - protein, 10 aa, Homo sapiens
IDAESRLNDN

SEQ ID NO: 864 - protein, 10 aa, Homo sapiens
NNKSEEAIDA

SEQ ID NO: 865 - protein, 10 aa, Homo sapiens
AIDAESRLND

SEQ ID NO: 866 - protein, 10 aa, Homo sapiens
KSEEAIDAES

SEQ ID NO: 867 - protein, 10 aa, Homo sapiens
NKSEEAIDAE

SEQ ID NO: 868 - protein, 10 aa, Homo sapiens
EAIDAESRLN

SEQ ID NO: 869 - protein, 10 aa, Homo sapiens
SEEAIDAESR

SEQ ID NO: 870 - protein, 9 aa, Homo sapiens
EEAIDAESR

SEQ ID NO: 871 - protein, 9 aa, Homo sapiens
EAIDAESRL

SEQ ID NO: 872 - protein, 9 aa, Homo sapiens
KSEEAIDAE

SEQ ID NO: 873 - protein, 9 aa, Homo sapiens
NKSEEAIDA

SEQ ID NO: 874 - protein, 9 aa, Homo sapiens
AESRLNDNV

SEQ ID NO: 875 - protein, 9 aa, Homo sapiens
AIDAESRLN

SEQ ID NO: 876 - protein, 9 aa, Homo sapiens
SEEAIDAES

SEQ ID NO: 877 - protein, 9 aa, Homo sapiens
DAESRLNDN

SEQ ID NO: 878 - protein, 9 aa, Homo sapiens
IDAESRLND

SEQ ID NO: 879 - protein, 10 aa, Homo sapiens
SEEAIDAESR

SEQ ID NO: 880 - protein, 10 aa, Homo sapiens
AIDAESRLND

SEQ ID NO: 881 - protein, 10 aa, Homo sapiens
KSEEAIDAES

SEQ ID NO: 882 - protein, 10 aa, Homo sapiens
NNKSEEAIDA

SEQ ID NO: 883 - protein, 10 aa, Homo sapiens
DAESRLNDNV

SEQ ID NO: 884 - protein, 10 aa, Homo sapiens
EEAIDAESRL

SEQ ID NO: 885 - protein, 10 aa, Homo sapiens
IDAESRLNDN

SEQ ID NO: 886 - protein, 10 aa, Homo sapiens
NKSEEAIDAE

SEQ ID NO: 887 - protein, 10 aa, Homo sapiens
EAIDAESRLN

SEQ ID NO: 888 - protein, 9 aa, Homo sapiens
EEAIDAESR

SEQ ID NO: 889 - protein, 9 aa, Homo sapiens
EAIDAESRL

SEQ ID NO: 890 - protein, 9 aa, Homo sapiens
AESRLNDNV

SEQ ID NO: 891 - protein, 9 aa, Homo sapiens
NKSEEAIDA

SEQ ID NO: 892 - protein, 9 aa, Homo sapiens
KSEEAIDAE

SEQ ID NO: 893 - protein, 9 aa, Homo sapiens
DAESRLNDN

SEQ ID NO: 894 - protein, 9 aa, Homo sapiens
SEEAIDAES

SEQ ID NO: 895 - protein, 9 aa, Homo sapiens
IDAESRLND

SEQ ID NO: 896 - protein, 9 aa, Homo sapiens
AIDAESRLN

SEQ ID NO: 897 - protein, 10 aa, Homo sapiens
SEEAIDAESR

SEQ ID NO: 898 - protein, 10 aa, Homo sapiens
NNKSEEAIDA

SEQ ID NO: 899 - protein, 10 aa, Homo sapiens
AIDAESRLND

SEQ ID NO: 900 - protein, 10 aa, Homo sapiens
DAESRLNDNV

SEQ ID NO: 901 - protein, 10 aa, Homo sapiens
EEAIDAESRL

SEQ ID NO: 902 - protein, 10 aa, Homo sapiens
KSEEAIDAES

SEQ ID NO: 903 - protein, 10 aa, Homo sapiens
IDAESRLNDN

SEQ ID NO: 904 - protein, 10 aa, Homo sapiens
NKSEEAIDAE

SEQ ID NO: 905 - protein, 10 aa, Homo sapiens
EAIDAESRLN

SEQ ID NO: 906 - protein, 9 aa, Homo sapiens
EAIDAESRL

SEQ ID NO: 907 - protein, 9 aa, Homo sapiens
DAESRLNDN

SEQ ID NO: 908 - protein, 9 aa, Homo sapiens
AIDAESRLN

SEQ ID NO: 909 - protein, 9 aa, Homo sapiens
KSEEAIDAE

SEQ ID NO: 910 - protein, 9 aa, Homo sapiens
SEEAIDAES

SEQ ID NO: 911 - protein, 9 aa, Homo sapiens
AESRLNDNV

SEQ ID NO: 912 - protein, 9 aa, Homo sapiens
NKSEEAIDA

SEQ ID NO: 913 - protein, 9 aa, Homo sapiens
IDAESRLND

SEQ ID NO: 914 - protein, 9 aa, Homo sapiens
EEAIDAESR

SEQ ID NO: 915 - protein, 10 aa, Homo sapiens
KSEEAIDAES

SEQ ID NO: 916 - protein, 10 aa, Homo sapiens
EEAIDAESRL

SEQ ID NO: 917 - protein, 10 aa, Homo sapiens
DAESRLNDNV

SEQ ID NO: 918 - protein, 10 aa, Homo sapiens
EAIDAESRLN

SEQ ID NO: 919 - protein, 10 aa, Homo sapiens
NNKSEEAIDA

SEQ ID NO: 920 - protein, 10 aa, Homo sapiens
IDAESRLNDN

SEQ ID NO: 921 - protein, 10 aa, Homo sapiens
AIDAESRLND

SEQ ID NO: 922 - protein, 10 aa, Homo sapiens
SEEAIDAESR

SEQ ID NO: 923 - protein, 10 aa, Homo sapiens
NKSEEAIDAE

SEQ ID NO: 924 - protein, 9 aa, Homo sapiens
EAIDAESRL

SEQ ID NO: 925 - protein, 9 aa, Homo sapiens
AESRLNDNV

SEQ ID NO: 926 - protein, 9 aa, Homo sapiens
AIDAESRLN

SEQ ID NO: 927 - protein, 9 aa, Homo sapiens
DAESRLNDN

SEQ ID NO: 928 - protein, 9 aa, Homo sapiens
NKSEEAIDA

SEQ ID NO: 929 - protein, 9 aa, Homo sapiens
KSEEAIDAE

SEQ ID NO: 930 - protein, 9 aa, Homo sapiens
IDAESRLND

SEQ ID NO: 931 - protein, 9 aa, Homo sapiens
EEAIDAESR

SEQ ID NO: 932 - protein, 9 aa, Homo sapiens
SEEAIDAES

SEQ ID NO: 933 - protein, 10 aa, Homo sapiens
EEAIDAESRL

SEQ ID NO: 934 - protein, 10 aa, Homo sapiens
DAESRLNDNV

SEQ ID NO: 935 - protein, 10 aa, Homo sapiens
NNKSEEAIDA

SEQ ID NO: 936 - protein, 10 aa, Homo sapiens
EAIDAESRLN

SEQ ID NO: 937 - protein, 10 aa, Homo sapiens
AIDAESRLND

SEQ ID NO: 938 - protein, 10 aa, Homo sapiens
KSEEAIDAES

SEQ ID NO: 939 - protein, 10 aa, Homo sapiens
IDAESRLNDN

SEQ ID NO: 940 - protein, 10 aa, Homo sapiens
NKSEEAIDAE

SEQ ID NO: 941 - protein, 10 aa, Homo sapiens
SEEAIDAESR

SEQ ID NO: 942 - protein, 9 aa, Homo sapiens
EAIDAESRL

SEQ ID NO: 943 - protein, 9 aa, Homo sapiens
DAESRLNDN

SEQ ID NO: 944 - protein, 9 aa, Homo sapiens
KSEEAIDAE

SEQ ID NO: 945 - protein, 9 aa, Homo sapiens
AIDAESRLN

SEQ ID NO: 946 - protein, 9 aa, Homo sapiens
NKSEEAIDA

SEQ ID NO: 947 - protein, 9 aa, Homo sapiens
AESRLNDNV

SEQ ID NO: 948 - protein, 9 aa, Homo sapiens
SEEAIDAES

SEQ ID NO: 949 - protein, 9 aa, Homo sapiens
IDAESRLND

SEQ ID NO: 950 - protein, 9 aa, Homo sapiens
EEAIDAESR

SEQ ID NO: 951 - protein, 10 aa, Homo sapiens
EAIDAESRLN

SEQ ID NO: 952 - protein, 10 aa, Homo sapiens
KSEEAIDAES

SEQ ID NO: 953 - protein, 10 aa, Homo sapiens
NNKSEEAIDA

SEQ ID NO: 954 - protein, 10 aa, Homo sapiens
DAESRLNDNV

SEQ ID NO: 955 - protein, 10 aa, Homo sapiens
EEAIDAESRL

SEQ ID NO: 956 - protein, 10 aa, Homo sapiens
IDAESRLNDN

SEQ ID NO: 957 - protein, 10 aa, Homo sapiens
AIDAESRLND

SEQ ID NO: 958 - protein, 10 aa, Homo sapiens
NKSEEAIDAE

SEQ ID NO: 959 - protein, 10 aa, Homo sapiens
SEEAIDAESR

SEQ ID NO: 960 - protein, 9 aa, Homo sapiens
IPEDILQKF

SEQ ID NO: 961 - protein, 9 aa, Homo sapiens
KIPEDILQK

SEQ ID NO: 962 - protein, 9 aa, Homo sapiens
WIYPTQKLN

SEQ ID NO: 963 - protein, 9 aa, Homo sapiens
IYPTQKLNK

SEQ ID NO: 964 - protein, 9 aa, Homo sapiens
ILQKFQWIY

SEQ ID NO: 965 - protein, 9 aa, Homo sapiens
DILQKFQWI

SEQ ID NO: 966 - protein, 9 aa, Homo sapiens
FQWIYPTQK

SEQ ID NO: 967 - protein, 9 aa, Homo sapiens
PEDILQKFQ

SEQ ID NO: 968 - protein, 9 aa, Homo sapiens
PTQKLNKMR

SEQ ID NO: 969 - protein, 9 aa, Homo sapiens
EDILQKFQW

SEQ ID NO: 970 - protein, 9 aa, Homo sapiens
YPTQKLNKM

SEQ ID NO: 971 - protein, 9 aa, Homo sapiens
QKFQWIYPT

SEQ ID NO: 972 - protein, 9 aa, Homo sapiens
KFQWIYPTQ

SEQ ID NO: 973 - protein, 9 aa, Homo sapiens
QWIYPTQKL

SEQ ID NO: 974 - protein, 9 aa, Homo sapiens
LQKFQWIYP

SEQ ID NO: 975 - protein, 10 aa, Homo sapiens
WIYPTQKLNK

SEQ ID NO: 976 - protein, 10 aa, Homo sapiens
TKIPEDILQK

SEQ ID NO: 977 - protein, 10 aa, Homo sapiens
DILQKFQWIY

SEQ ID NO: 978 - protein, 10 aa, Homo sapiens
IPEDILQKFQ

SEQ ID NO: 979 - protein, 10 aa, Homo sapiens
KIPEDILQKF

SEQ ID NO: 980 - protein, 10 aa, Homo sapiens
YPTQKLNKMR

SEQ ID NO: 981 - protein, 10 aa, Homo sapiens
PEDILQKFQW

SEQ ID NO: 982 - protein, 10 aa, Homo sapiens
KFQWIYPTQK

SEQ ID NO: 983 - protein, 10 aa, Homo sapiens
QKFQWIYPTQ

SEQ ID NO: 984 - protein, 10 aa, Homo sapiens
ILQKFQWIYP

SEQ ID NO: 985 - protein, 10 aa, Homo sapiens
IYPTQKLNKM

SEQ ID NO: 986 - protein, 10 aa, Homo sapiens
QWIYPTQKLN

SEQ ID NO: 987 - protein, 10 aa, Homo sapiens
EDILQKFQWI

SEQ ID NO: 988 - protein, 10 aa, Homo sapiens
LQKFQWIYPT

SEQ ID NO: 989 - protein, 10 aa, Homo sapiens
FQWIYPTQKL

SEQ ID NO: 990 - protein, 9 aa, Homo sapiens
DILQKFQWI

SEQ ID NO: 991 - protein, 9 aa, Homo sapiens
ILQKFQWIY

SEQ ID NO: 992 - protein, 9 aa, Homo sapiens
YPTQKLNKM

SEQ ID NO: 993 - protein, 9 aa, Homo sapiens
WIYPTQKLN

SEQ ID NO: 994 - protein, 9 aa, Homo sapiens
QKFQWIYPT

SEQ ID NO: 995 - protein, 9 aa, Homo sapiens
KIPEDILQK

SEQ ID NO: 996 - protein, 9 aa, Homo sapiens
FQWIYPTQK

SEQ ID NO: 997 - protein, 9 aa, Homo sapiens
QWIYPTQKL

SEQ ID NO: 998 - protein, 9 aa, Homo sapiens
LQKFQWIYP

SEQ ID NO: 999 - protein, 9 aa, Homo sapiens
IPEDILQKF

SEQ ID NO: 1000 - protein, 9 aa, Homo sapiens
KFQWIYPTQ

SEQ ID NO: 1001 - protein, 9 aa, Homo sapiens
EDILQKFQW

SEQ ID NO: 1002 - protein, 9 aa, Homo sapiens
PEDILQKFQ

SEQ ID NO: 1003 - protein, 9 aa, Homo sapiens
PTQKLNKMR

SEQ ID NO: 1004 - protein, 9 aa, Homo sapiens
IYPTQKLNK

SEQ ID NO: 1005 - protein, 10 aa, Homo sapiens
FQWIYPTQKL

SEQ ID NO: 1006 - protein, 10 aa, Homo sapiens
KIPEDILQKF

SEQ ID NO: 1007 - protein, 10 aa, Homo sapiens
ILQKFQWIYP

SEQ ID NO: 1008 - protein, 10 aa, Homo sapiens
LQKFQWIYPT

SEQ ID NO: 1009 - protein, 10 aa, Homo sapiens
DILQKFQWIY

SEQ ID NO: 1010 - protein, 10 aa, Homo sapiens
WIYPTQKLNK

SEQ ID NO: 1011 - protein, 10 aa, Homo sapiens
EDILQKFQWI

SEQ ID NO: 1012 - protein, 10 aa, Homo sapiens
IYPTQKLNKM

SEQ ID NO: 1013 - protein, 10 aa, Homo sapiens
YPTQKLNKMR

SEQ ID NO: 1014 - protein, 10 aa, Homo sapiens
IPEDILQKFQ

SEQ ID NO: 1015 - protein, 10 aa, Homo sapiens
QKFQWIYPTQ

SEQ ID NO: 1016 - protein, 10 aa, Homo sapiens
PEDILQKFQW

SEQ ID NO: 1017 - protein, 10 aa, Homo sapiens
TKIPEDILQK

SEQ ID NO: 1018 - protein, 10 aa, Homo sapiens
KFQWIYPTQK

SEQ ID NO: 1019 - protein, 10 aa, Homo sapiens
QWIYPTQKLN

SEQ ID NO: 1020 - protein, 9 aa, Homo sapiens
ILQKFQWIY

SEQ ID NO: 1021 - protein, 9 aa, Homo sapiens
KIPEDILQK

SEQ ID NO: 1022 - protein, 9 aa, Homo sapiens
FQWIYPTQK

SEQ ID NO: 1023 - protein, 9 aa, Homo sapiens
DILQKFQWI

SEQ ID NO: 1024 - protein, 9 aa, Homo sapiens
IPEDILQKF

SEQ ID NO: 1025 - protein, 9 aa, Homo sapiens
IYPTQKLNK

SEQ ID NO: 1026 - protein, 9 aa, Homo sapiens
PTQKLNKMR

SEQ ID NO: 1027 - protein, 9 aa, Homo sapiens
WIYPTQKLN

SEQ ID NO: 1028 - protein, 9 aa, Homo sapiens
QKFQWIYPT

SEQ ID NO: 1029 - protein, 9 aa, Homo sapiens
YPTQKLNKM

SEQ ID NO: 1030 - protein, 9 aa, Homo sapiens
QWIYPTQKL

SEQ ID NO: 1031 - protein, 9 aa, Homo sapiens
LQKFQWIYP

SEQ ID NO: 1032 - protein, 9 aa, Homo sapiens
EDILQKFQW

SEQ ID NO: 1033 - protein, 9 aa, Homo sapiens
KFQWIYPTQ

SEQ ID NO: 1034 - protein, 9 aa, Homo sapiens
PEDILQKFQ

SEQ ID NO: 1035 - protein, 10 aa, Homo sapiens
WIYPTQKLNK

SEQ ID NO: 1036 - protein, 10 aa, Homo sapiens
KIPEDILQKF

SEQ ID NO: 1037 - protein, 10 aa, Homo sapiens
DILQKFQWIY

SEQ ID NO: 1038 - protein, 10 aa, Homo sapiens
KFQWIYPTQK

SEQ ID NO: 1039 - protein, 10 aa, Homo sapiens
TKIPEDILQK

SEQ ID NO: 1040 - protein, 10 aa, Homo sapiens
FQWIYPTQKL

SEQ ID NO: 1041 - protein, 10 aa, Homo sapiens
LQKFQWIYPT

SEQ ID NO: 1042 - protein, 10 aa, Homo sapiens
ILQKFQWIYP

SEQ ID NO: 1043 - protein, 10 aa, Homo sapiens
YPTQKLNKMR

SEQ ID NO: 1044 - protein, 10 aa, Homo sapiens
EDILQKFQWI

SEQ ID NO: 1045 - protein, 10 aa, Homo sapiens
IYPTQKLNKM

SEQ ID NO: 1046 - protein, 10 aa, Homo sapiens
PEDILQKFQW

SEQ ID NO: 1047 - protein, 10 aa, Homo sapiens
QKFQWIYPTQ

SEQ ID NO: 1048 - protein, 10 aa, Homo sapiens
IPEDILQKFQ

SEQ ID NO: 1049 - protein, 10 aa, Homo sapiens
QWIYPTQKLN

SEQ ID NO: 1050 - protein, 9 aa, Homo sapiens
KIPEDILQK

SEQ ID NO: 1051 - protein, 9 aa, Homo sapiens
FQWIYPTQK

SEQ ID NO: 1052 - protein, 9 aa, Homo sapiens
IYPTQKLNK

SEQ ID NO: 1053 - protein, 9 aa, Homo sapiens
PTQKLNKMR

SEQ ID NO: 1054 - protein, 9 aa, Homo sapiens
ILQKFQWIY

SEQ ID NO: 1055 - protein, 9 aa, Homo sapiens
YPTQKLNKM

SEQ ID NO: 1056 - protein, 9 aa, Homo sapiens
IPEDILQKF

SEQ ID NO: 1057 - protein, 9 aa, Homo sapiens
DILQKFQWI

SEQ ID NO: 1058 - protein, 9 aa, Homo sapiens
LQKFQWIYP

SEQ ID NO: 1059 - protein, 9 aa, Homo sapiens
KFQWIYPTQ

SEQ ID NO: 1060 - protein, 9 aa, Homo sapiens
WIYPTQKLN

SEQ ID NO: 1061 - protein, 9 aa, Homo sapiens
QWIYPTQKL

SEQ ID NO: 1062 - protein, 9 aa, Homo sapiens
EDILQKFQW

SEQ ID NO: 1063 - protein, 9 aa, Homo sapiens
QKFQWIYPT

SEQ ID NO: 1064 - protein, 9 aa, Homo sapiens
PEDILQKFQ

SEQ ID NO: 1065 - protein, 10 aa, Homo sapiens
WIYPTQKLNK

SEQ ID NO: 1066 - protein, 10 aa, Homo sapiens
KFQWIYPTQK

SEQ ID NO: 1067 - protein, 10 aa, Homo sapiens
TKIPEDILQK

SEQ ID NO: 1068 - protein, 10 aa, Homo sapiens
YPTQKLNKMR

SEQ ID NO: 1069 - protein, 10 aa, Homo sapiens
KIPEDILQKF

SEQ ID NO: 1070 - protein, 10 aa, Homo sapiens
FQWIYPTQKL

SEQ ID NO: 1071 - protein, 10 aa, Homo sapiens
IYPTQKLNKM

SEQ ID NO: 1072 - protein, 10 aa, Homo sapiens
DILQKFQWIY

SEQ ID NO: 1073 - protein, 10 aa, Homo sapiens
LQKFQWIYPT

SEQ ID NO: 1074 - protein, 10 aa, Homo sapiens
ILQKFQWIYP

SEQ ID NO: 1075 - protein, 10 aa, Homo sapiens
PEDILQKFQW

SEQ ID NO: 1076 - protein, 10 aa, Homo sapiens
IPEDILQKFQ

SEQ ID NO: 1077 - protein, 10 aa, Homo sapiens
EDILQKFQWI

SEQ ID NO: 1078 - protein, 10 aa, Homo sapiens
QKFQWIYPTQ

SEQ ID NO: 1079 - protein, 10 aa, Homo sapiens
QWIYPTQKLN

SEQ ID NO: 1080 - protein, 9 aa, Homo sapiens
QWIYPTQKL

SEQ ID NO: 1081 - protein, 9 aa, Homo sapiens
IPEDILQKF

SEQ ID NO: 1082 - protein, 9 aa, Homo sapiens
DILQKFQWI

SEQ ID NO: 1083 - protein, 9 aa, Homo sapiens
IYPTQKLNK

SEQ ID NO: 1084 - protein, 9 aa, Homo sapiens
YPTQKLNKM

SEQ ID NO: 1085 - protein, 9 aa, Homo sapiens
KFQWIYPTQ

SEQ ID NO: 1086 - protein, 9 aa, Homo sapiens
ILQKFQWIY

SEQ ID NO: 1087 - protein, 9 aa, Homo sapiens
WIYPTQKLN

SEQ ID NO: 1088 - protein, 9 aa, Homo sapiens
KIPEDILQK

SEQ ID NO: 1089 - protein, 9 aa, Homo sapiens
EDILQKFQW

SEQ ID NO: 1090 - protein, 9 aa, Homo sapiens
LQKFQWIYP

SEQ ID NO: 1091 - protein, 9 aa, Homo sapiens
QKFQWIYPT

SEQ ID NO: 1092 - protein, 9 aa, Homo sapiens
FQWIYPTQK

SEQ ID NO: 1093 - protein, 9 aa, Homo sapiens
PTQKLNKMR

SEQ ID NO: 1094 - protein, 9 aa, Homo sapiens
PEDILQKFQ

SEQ ID NO: 1095 - protein, 10 aa, Homo sapiens
IYPTQKLNKM

SEQ ID NO: 1096 - protein, 10 aa, Homo sapiens
KIPEDILQKF

SEQ ID NO: 1097 - protein, 10 aa, Homo sapiens
FQWIYPTQKL

SEQ ID NO: 1098 - protein, 10 aa, Homo sapiens
EDILQKFQWI

SEQ ID NO: 1099 - protein, 10 aa, Homo sapiens
KFQWIYPTQK

SEQ ID NO: 1100 - protein, 10 aa, Homo sapiens
DILQKFQWIY

SEQ ID NO: 1101 - protein, 10 aa, Homo sapiens
QWIYPTQKLN

SEQ ID NO: 1102 - protein, 10 aa, Homo sapiens
LQKFQWIYPT

SEQ ID NO: 1103 - protein, 10 aa, Homo sapiens
IPEDILQKFQ

SEQ ID NO: 1104 - protein, 10 aa, Homo sapiens
ILQKFQWIYP

SEQ ID NO: 1105 - protein, 10 aa, Homo sapiens
YPTQKLNKMR

SEQ ID NO: 1106 - protein, 10 aa, Homo sapiens
WIYPTQKLNK

SEQ ID NO: 1107 - protein, 10 aa, Homo sapiens
TKIPEDILQK

SEQ ID NO: 1108 - protein, 10 aa, Homo sapiens
QKFQWIYPTQ

SEQ ID NO: 1109 - protein, 10 aa, Homo sapiens
PEDILQKFQW

SEQ ID NO: 1110 - protein, 9 aa, Homo sapiens
YPTQKLNKM

SEQ ID NO: 1111 - protein, 9 aa, Homo sapiens
QWIYPTQKL

SEQ ID NO: 1112 - protein, 9 aa, Homo sapiens
DILQKFQWI

SEQ ID NO: 1113 - protein, 9 aa, Homo sapiens
IPEDILQKF

SEQ ID NO: 1114 - protein, 9 aa, Homo sapiens
WIYPTQKLN

SEQ ID NO: 1115 - protein, 9 aa, Homo sapiens
ILQKFQWIY

SEQ ID NO: 1116 - protein, 9 aa, Homo sapiens
QKFQWIYPT

SEQ ID NO: 1117 - protein, 9 aa, Homo sapiens
LQKFQWIYP

SEQ ID NO: 1118 - protein, 9 aa, Homo sapiens
FQWIYPTQK

SEQ ID NO: 1119 - protein, 9 aa, Homo sapiens
KIPEDILQK

SEQ ID NO: 1120 - protein, 9 aa, Homo sapiens
EDILQKFQW

SEQ ID NO: 1121 - protein, 9 aa, Homo sapiens
IYPTQKLNK

SEQ ID NO: 1122 - protein, 9 aa, Homo sapiens
PTQKLNKMR

SEQ ID NO: 1123 - protein, 9 aa, Homo sapiens
KFQWIYPTQ

SEQ ID NO: 1124 - protein, 9 aa, Homo sapiens
PEDILQKFQ

SEQ ID NO: 1125 - protein, 10 aa, Homo sapiens
FQWIYPTQKL

SEQ ID NO: 1126 - protein, 10 aa, Homo sapiens
YPTQKLNKMR

SEQ ID NO: 1127 - protein, 10 aa, Homo sapiens
IYPTQKLNKM

SEQ ID NO: 1128 - protein, 10 aa, Homo sapiens
LQKFQWIYPT

SEQ ID NO: 1129 - protein, 10 aa, Homo sapiens
IPEDILQKFQ

SEQ ID NO: 1130 - protein, 10 aa, Homo sapiens
EDILQKFQWI

SEQ ID NO: 1131 - protein, 10 aa, Homo sapiens
DILQKFQWIY

SEQ ID NO: 1132 - protein, 10 aa, Homo sapiens
KIPEDILQKF

SEQ ID NO: 1133 - protein, 10 aa, Homo sapiens
WIYPTQKLNK

SEQ ID NO: 1134 - protein, 10 aa, Homo sapiens
ILQKFQWIYP

SEQ ID NO: 1135 - protein, 10 aa, Homo sapiens
QWIYPTQKLN

SEQ ID NO: 1136 - protein, 10 aa, Homo sapiens
QKFQWIYPTQ

SEQ ID NO: 1137 - protein, 10 aa, Homo sapiens
KFQWIYPTQK

SEQ ID NO: 1138 - protein, 10 aa, Homo sapiens
TKIPEDILQK

SEQ ID NO: 1139 - protein, 10 aa, Homo sapiens
PEDILQKFQW

SEQ ID NO: 1140 - protein, 9 aa, Homo sapiens
YPTQKLNKM

SEQ ID NO: 1141 - protein, 9 aa, Homo sapiens
IPEDILQKF

SEQ ID NO: 1142 - protein, 9 aa, Homo sapiens
ILQKFQWIY

SEQ ID NO: 1143 - protein, 9 aa, Homo sapiens
DILQKFQWI

SEQ ID NO: 1144 - protein, 9 aa, Homo sapiens
QWIYPTQKL

SEQ ID NO: 1145 - protein, 9 aa, Homo sapiens
WIYPTQKLN

SEQ ID NO: 1146 - protein, 9 aa, Homo sapiens
KIPEDILQK

SEQ ID NO: 1147 - protein, 9 aa, Homo sapiens
EDILQKFQW

SEQ ID NO: 1148 - protein, 9 aa, Homo sapiens
LQKFQWIYP

SEQ ID NO: 1149 - protein, 9 aa, Homo sapiens
FQWIYPTQK

SEQ ID NO: 1150 - protein, 9 aa, Homo sapiens
QKFQWIYPT

SEQ ID NO: 1151 - protein, 9 aa, Homo sapiens
KFQWIYPTQ

SEQ ID NO: 1152 - protein, 9 aa, Homo sapiens
IYPTQKLNK

SEQ ID NO: 1153 - protein, 9 aa, Homo sapiens
PTQKLNKMR

SEQ ID NO: 1154 - protein, 9 aa, Homo sapiens
PEDILQKFQ

SEQ ID NO: 1155 - protein, 10 aa, Homo sapiens
KIPEDILQKF

SEQ ID NO: 1156 - protein, 10 aa, Homo sapiens
DILQKFQWIY

SEQ ID NO: 1157 - protein, 10 aa, Homo sapiens
FQWIYPTQKL

SEQ ID NO: 1158 - protein, 10 aa, Homo sapiens
LQKFQWIYPT

SEQ ID NO: 1159 - protein, 10 aa, Homo sapiens
YPTQKLNKMR

SEQ ID NO: 1160 - protein, 10 aa, Homo sapiens
IYPTQKLNKM

SEQ ID NO: 1161 - protein, 10 aa, Homo sapiens
IPEDILQKFQ

SEQ ID NO: 1162 - protein, 10 aa, Homo sapiens
EDILQKFQWI

SEQ ID NO: 1163 - protein, 10 aa, Homo sapiens
ILQKFQWIYP

SEQ ID NO: 1164 - protein, 10 aa, Homo sapiens
QWIYPTQKLN

SEQ ID NO: 1165 - protein, 10 aa, Homo sapiens
WIYPTQKLNK

SEQ ID NO: 1166 - protein, 10 aa, Homo sapiens
KFQWIYPTQK

SEQ ID NO: 1167 - protein, 10 aa, Homo sapiens
PEDILQKFQW

SEQ ID NO: 1168 - protein, 10 aa, Homo sapiens
TKIPEDILQK

SEQ ID NO: 1169 - protein, 10 aa, Homo sapiens
QKFQWIYPTQ

SEQ ID NO: 1170 - protein, 9 aa, Homo sapiens
DGEESLLSK

SEQ ID NO: 1171 - protein, 9 aa, Homo sapiens
GEESLLSKY

SEQ ID NO: 1172 - protein, 9 aa, Homo sapiens
ALDGEESLL

SEQ ID NO: 1173 - protein, 9 aa, Homo sapiens
ESLLSKYNS

SEQ ID NO: 1174 - protein, 9 aa, Homo sapiens
SLLSKYNSN

SEQ ID NO: 1175 - protein, 9 aa, Homo sapiens
RALDGEESL

SEQ ID NO: 1176 - protein, 9 aa, Homo sapiens
LDGEESLLS

SEQ ID NO: 1177 - protein, 9 aa, Homo sapiens
EESLLSKYN

SEQ ID NO: 1178 - protein, 10 aa, Homo sapiens
DGEESLLSKY

SEQ ID NO: 1179 - protein, 10 aa, Homo sapiens
ALDGEESLLS

SEQ ID NO: 1180 - protein, 10 aa, Homo sapiens
LDGEESLLSK

SEQ ID NO: 1181 - protein, 10 aa, Homo sapiens
GEESLLSKYN

SEQ ID NO: 1182 - protein, 10 aa, Homo sapiens
ESLLSKYNSN

SEQ ID NO: 1183 - protein, 10 aa, Homo sapiens
SLLSKYNSNL

SEQ ID NO: 1184 - protein, 10 aa, Homo sapiens
RALDGEESLL

SEQ ID NO: 1185 - protein, 10 aa, Homo sapiens
EESLLSKYNS

SEQ ID NO: 1186 - protein, 9 aa, Homo sapiens
ALDGEESLL

SEQ ID NO: 1187 - protein, 9 aa, Homo sapiens
RALDGEESL

SEQ ID NO: 1188 - protein, 9 aa, Homo sapiens
SLLSKYNSN

SEQ ID NO: 1189 - protein, 9 aa, Homo sapiens
LDGEESLLS

SEQ ID NO: 1190 - protein, 9 aa, Homo sapiens
EESLLSKYN

SEQ ID NO: 1191 - protein, 9 aa, Homo sapiens
GEESLLSKY

SEQ ID NO: 1192 - protein, 9 aa, Homo sapiens
ESLLSKYNS

SEQ ID NO: 1193 - protein, 9 aa, Homo sapiens
DGEESLLSK

SEQ ID NO: 1194 - protein, 10 aa, Homo sapiens
SLLSKYNSNL

SEQ ID NO: 1195 - protein, 10 aa, Homo sapiens
RALDGEESLL

SEQ ID NO: 1196 - protein, 10 aa, Homo sapiens
ALDGEESLLS

SEQ ID NO: 1197 - protein, 10 aa, Homo sapiens
QRALDGEESL

SEQ ID NO: 1198 - protein, 10 aa, Homo sapiens
GEESLLSKYN

SEQ ID NO: 1199 - protein, 10 aa, Homo sapiens
LDGEESLLSK

SEQ ID NO: 1200 - protein, 10 aa, Homo sapiens
ESLLSKYNSN

SEQ ID NO: 1201 - protein, 10 aa, Homo sapiens
EESLLSKYNS

SEQ ID NO: 1202 - protein, 9 aa, Homo sapiens
ALDGEESLL

SEQ ID NO: 1203 - protein, 9 aa, Homo sapiens
GEESLLSKY

SEQ ID NO: 1204 - protein, 9 aa, Homo sapiens
SLLSKYNSN

SEQ ID NO: 1205 - protein, 9 aa, Homo sapiens
DGEESLLSK

SEQ ID NO: 1206 - protein, 9 aa, Homo sapiens
RALDGEESL

SEQ ID NO: 1207 - protein, 9 aa, Homo sapiens
ESLLSKYNS

SEQ ID NO: 1208 - protein, 9 aa, Homo sapiens
LDGEESLLS

SEQ ID NO: 1209 - protein, 9 aa, Homo sapiens
EESLLSKYN

SEQ ID NO: 1210 - protein, 10 aa, Homo sapiens
SLLSKYNSNL

SEQ ID NO: 1211 - protein, 10 aa, Homo sapiens
ALDGEESLLS

SEQ ID NO: 1212 - protein, 10 aa, Homo sapiens
LDGEESLLSK

SEQ ID NO: 1213 - protein, 10 aa, Homo sapiens
RALDGEESLL

SEQ ID NO: 1214 - protein, 10 aa, Homo sapiens
DGEESLLSKY

SEQ ID NO: 1215 - protein, 10 aa, Homo sapiens
QRALDGEESL

SEQ ID NO: 1216 - protein, 10 aa, Homo sapiens
EESLLSKYNS

SEQ ID NO: 1217 - protein, 10 aa, Homo sapiens
GEESLLSKYN

SEQ ID NO: 1218 - protein, 9 aa, Homo sapiens
DGEESLLSK

SEQ ID NO: 1219 - protein, 9 aa, Homo sapiens
RALDGEESL

SEQ ID NO: 1220 - protein, 9 aa, Homo sapiens
ALDGEESLL

SEQ ID NO: 1221 - protein, 9 aa, Homo sapiens
GEESLLSKY

SEQ ID NO: 1222 - protein, 9 aa, Homo sapiens
SLLSKYNSN

SEQ ID NO: 1223 - protein, 9 aa, Homo sapiens
LDGEESLLS

SEQ ID NO: 1224 - protein, 9 aa, Homo sapiens
ESLLSKYNS

SEQ ID NO: 1225 - protein, 9 aa, Homo sapiens
EESLLSKYN

SEQ ID NO: 1226 - protein, 10 aa, Homo sapiens
LDGEESLLSK

SEQ ID NO: 1227 - protein, 10 aa, Homo sapiens
RALDGEESLL

SEQ ID NO: 1228 - protein, 10 aa, Homo sapiens
SLLSKYNSNL

SEQ ID NO: 1229 - protein, 10 aa, Homo sapiens
ALDGEESLLS

SEQ ID NO: 1230 - protein, 10 aa, Homo sapiens
QRALDGEESL

SEQ ID NO: 1231 - protein, 10 aa, Homo sapiens
GEESLLSKYN

SEQ ID NO: 1232 - protein, 10 aa, Homo sapiens
DGEESLLSKY

SEQ ID NO: 1233 - protein, 10 aa, Homo sapiens
EESLLSKYNS

SEQ ID NO: 1234 - protein, 9 aa, Homo sapiens
RALDGEESL

SEQ ID NO: 1235 - protein, 9 aa, Homo sapiens
ALDGEESLL

SEQ ID NO: 1236 - protein, 9 aa, Homo sapiens
SLLSKYNSN

SEQ ID NO: 1237 - protein, 9 aa, Homo sapiens
ESLLSKYNS

SEQ ID NO: 1238 - protein, 9 aa, Homo sapiens
GEESLLSKY

SEQ ID NO: 1239 - protein, 9 aa, Homo sapiens
DGEESLLSK

SEQ ID NO: 1240 - protein, 9 aa, Homo sapiens
EESLLSKYN

SEQ ID NO: 1241 - protein, 9 aa, Homo sapiens
LDGEESLLS

SEQ ID NO: 1242 - protein, 10 aa, Homo sapiens
RALDGEESLL

SEQ ID NO: 1243 - protein, 10 aa, Homo sapiens
SLLSKYNSNL

SEQ ID NO: 1244 - protein, 10 aa, Homo sapiens
QRALDGEESL

SEQ ID NO: 1245 - protein, 10 aa, Homo sapiens
DGEESLLSKY

SEQ ID NO: 1246 - protein, 10 aa, Homo sapiens
ESLLSKYNSN

SEQ ID NO: 1247 - protein, 10 aa, Homo sapiens
ALDGEESLLS

SEQ ID NO: 1248 - protein, 10 aa, Homo sapiens
GEESLLSKYN

SEQ ID NO: 1249 - protein, 10 aa, Homo sapiens
EESLLSKYNS

SEQ ID NO: 1250 - protein, 9 aa, Homo sapiens
RALDGEESL

SEQ ID NO: 1251 - protein, 9 aa, Homo sapiens
ALDGEESLL

SEQ ID NO: 1252 - protein, 9 aa, Homo sapiens
ESLLSKYNS

SEQ ID NO: 1253 - protein, 9 aa, Homo sapiens
SLLSKYNSN

SEQ ID NO: 1254 - protein, 9 aa, Homo sapiens
DGEESLLSK

SEQ ID NO: 1255 - protein, 9 aa, Homo sapiens
LDGEESLLS

SEQ ID NO: 1256 - protein, 9 aa, Homo sapiens
EESLLSKYN

SEQ ID NO: 1257 - protein, 9 aa, Homo sapiens
GEESLLSKY

SEQ ID NO: 1258 - protein, 10 aa, Homo sapiens
RALDGEESLL

SEQ ID NO: 1259 - protein, 10 aa, Homo sapiens
SLLSKYNSNL

SEQ ID NO: 1260 - protein, 10 aa, Homo sapiens
QRALDGEESL

SEQ ID NO: 1261 - protein, 10 aa, Homo sapiens
ESLLSKYNSN

SEQ ID NO: 1262 - protein, 10 aa, Homo sapiens
ALDGEESLLS

SEQ ID NO: 1263 - protein, 10 aa, Homo sapiens
DGEESLLSKY

SEQ ID NO: 1264 - protein, 10 aa, Homo sapiens
EESLLSKYNS

SEQ ID NO: 1265 - protein, 10 aa, Homo sapiens
LDGEESLLSK

SEQ ID NO: 1266 - protein, 9 aa, Homo sapiens
RALDGEESL

SEQ ID NO: 1267 - protein, 9 aa, Homo sapiens
ESLLSKYNS

SEQ ID NO: 1268 - protein, 9 aa, Homo sapiens
ALDGEESLL

SEQ ID NO: 1269 - protein, 9 aa, Homo sapiens
SLLSKYNSN

SEQ ID NO: 1270 - protein, 9 aa, Homo sapiens
GEESLLSKY

SEQ ID NO: 1271 - protein, 9 aa, Homo sapiens
LDGEESLLS

SEQ ID NO: 1272 - protein, 9 aa, Homo sapiens
EESLLSKYN

SEQ ID NO: 1273 - protein, 9 aa, Homo sapiens
DGEESLLSK

SEQ ID NO: 1274 - protein, 10 aa, Homo sapiens
RALDGEESLL

SEQ ID NO: 1275 - protein, 10 aa, Homo sapiens
DGEESLLSKY

SEQ ID NO: 1276 - protein, 10 aa, Homo sapiens
SLLSKYNSNL

SEQ ID NO: 1277 - protein, 10 aa, Homo sapiens
ESLLSKYNSN

SEQ ID NO: 1278 - protein, 10 aa, Homo sapiens
QRALDGEESL

SEQ ID NO: 1279 - protein, 10 aa, Homo sapiens
ALDGEESLLS

SEQ ID NO: 1280 - protein, 10 aa, Homo sapiens
EESLLSKYNS

SEQ ID NO: 1281 - protein, 10 aa, Homo sapiens
GEESLLSKYN

SEQ ID NO: 1282 - protein, 17 aa, Artificial Sequence
  Description of Artificial Sequence: Variant 2
PVASSCISGKSPRSPQL

SEQ ID NO: 1283 - protein, 19 aa, Artificial Sequence
  Description of Artificial Sequence: Variant 2
PPVASSCISGKSPRSPQLS

SEQ ID NO: 1284 - protein, 17 aa, Artificial Sequence
  Description of Artificial Sequence: Variant 3
NKSEEAIDAESRLNDNV

SEQ ID NO: 1285 - protein, 18 aa, Artificial Sequence
  Description of Artificial Sequence: Variant 3
NNKSEEAIDAESRLNDNV

SEQ ID NO: 1286 - protein, 23 aa, Artificial Sequence
  Description of Artificial Sequence: Variant 4 and 5
KIPEDILQKFQWIYPTQKLNKMR

SEQ ID NO: 1287 - protein, 24 aa, Artificial Sequence
  Description of Artificial Sequence: Variant 4 and 5
TKIPEDILQKFQWIYPTQKLNKMR

SEQ ID NO: 1288 - protein, 16 aa, Artificial Sequence
  Description of Artificial Sequence: Variant 6
RALDGEESLLSKYNSN

SEQ ID NO: 1289 - protein, 18 aa, Artificial Sequence
  Description of Artificial Sequence: Variant 6
QRALDGEESLLSKYNSNL

SEQ ID NO: 1290 - protein, 4 aa, Artificial Sequence
  Description of Artificial Sequence: Synthetic motif
NKSE

SEQ ID NO: 1291 - protein, 4 aa, Artificial Sequence
  Description of Artificial Sequence: Synthetic motif
NSSS

SEQ ID NO: 1292 - protein, 4 aa, Artificial Sequence
  Description of Artificial Sequence: Synthetic motif
NLTD

SEQ ID NO: 1293 - protein, 4 aa, Artificial Sequence
  Description of Artificial Sequence: Synthetic motif
KKNS

SEQ ID NO: 1294 - protein, 4 aa, Artificial Sequence
  Description of Artificial Sequence: Synthetic motif
STLD

SEQ ID NO: 1295 - protein, 4 aa, Artificial Sequence
  Description of Artificial Sequence: Synthetic motif
SDFE

SEQ ID NO: 1296 - protein, 4 aa, Artificial Sequence
  Description of Artificial Sequence: Synthetic motif
TLKD

SEQ ID NO: 1297 - protein, 4 aa, Artificial Sequence
  Description of Artificial Sequence: Synthetic motif
SVHE

SEQ ID NO: 1298 - protein, 4 aa, Artificial Sequence
  Description of Artificial Sequence: Synthetic motif
SDPE

SEQ ID NO: 1299 - protein, 4 aa, Artificial Sequence
  Description of Artificial Sequence: Synthetic motif
SNCE

SEQ ID NO: 1300 - protein, 4 aa, Artificial Sequence
  Description of Artificial Sequence: Synthetic motif
SDAE

SEQ ID NO: 1301 - protein, 4 aa, Artificial Sequence
  Description of Artificial Sequence: Synthetic motif
SSND

SEQ ID NO: 1302 - protein, 4 aa, Artificial Sequence
  Description of Artificial Sequence: Synthetic motif
TCFE

SEQ ID NO: 1303 - protein, 4 aa, Artificial Sequence
  Description of Artificial Sequence: Synthetic motif
SSYE

SEQ ID NO: 1304 - protein, 4 aa, Artificial Sequence
  Description of Artificial Sequence: Synthetic motif
TPPE

SEQ ID NO: 1305 - protein, 4 aa, Artificial Sequence
  Description of Artificial Sequence: Synthetic motif
SNKE

SEQ ID NO: 1306 - protein, 6 aa, Artificial Sequence
  Description of Artificial Sequence: Synthetic motif
GLKNAR

SEQ ID NO: 1307 - DNA, 2736 bp, Unknown Organism
  Description of Unknown Organism: 193P1E1B v.3 variant nucleotide sequence
tatcatctgtgactgaggaaatccctatcttcctatcagactaatgaaaccacaggacagcaattagacttttaagtattggggggtttagagctctagatattcgatatgcagactactcatgtttgtttgttttaataaagactggtccaaaggctcattttcacacaagctacagtttttcagttccaggaccaggtaaagatggtcagctccgtgatccataaaatccaagggtgacgactcaggattaggaccatttcttggtgacattgagatggtcgagctggtccgcaatgaatctatgcggggggaacttggaagtggcggccgcctttatggcctcgaaggcctccctcctgcgcaccgcggcgtggccgcgctcctgctcccgggtcatgtagggcatgctcagccagtaatggttctccgcctcgatctccaggcggcggatcatgttctgcttggcgcgcaacgacacgaaccgcggccgccggtgcttcccgatccactgacggccgggaatgcggccgcgccagaggagcgcagtcaggaacatggtgcctgccgcgctgctcaagactctgcgtctccgcggccgccagcagacgccgtggcgtaagcgcacccgtctcgcggggtctccgggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatgcagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccagaagtaactaaaattccagaagatattctccagcttttatcaaaatacaactcaaacctagctactccaatagcaattaaagcagtgccacccagtaaaaggttccttaaacatggacagaacatccgagatgtcagcaacaaagaaaactgaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggactattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaacagagggagatttccaggcctgggtaactatatactgtgaccattggcggttgagaccggtcttcaaccagtggaaccccgaactctgctgtcagggtgtggacttcggtgctcttccaagttttcacctgggggggggagctaaccccctatgttcacgccttctattcccattggcgctgaactcttaaggtcactctggtcgcttgtgaccccgtaaccctgatgtacccctctaaaaggtgaggggc

SEQ ID NO: 1308 - DNA, 2798 bp, Unknown Organism
  Description of Unknown Organism: 193P1E1B v.1 cDNA sequence
  CDS (805)..(2040)
tatcatctgtgactgaggaaatccctatcttcctatcagactaatgaaaccacaggacagcaattagacttttaagtattggggggtttagagctctagatattcgatatgcagactactcatgtttgtttgttttaataaagactggtccaaaggctcattttcacacaagctacagtttttcagttccaggaccaggtaaagatggtcagctccgtgatccataaaatccaagggtgacgactcaggattaggaccatttcttggtgacattgagatggtcgagctggtccgcaatgaatctatgcggggggaacttggaagtggcggccgcctttatggcctcgaaggcctccctcctgcgcaccgcggcgtggccgcgctcctgctcccgggtcatgtagggcatgctcagccagtaatggttctccgcctcgatctccaggcggcggatcatgttctgcttggcgcgcaacgacacgaaccgcggccgccggtgcttcccgatccactgacggccgggaatgcggccgcgccagaggagcgcagtcaggaacatggtgcctgccgcgctgctcaagactctgcgtctccgcggccgccagcagacgccgtggcgtaagcgcacccgtctcgcggggtctccgggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccagaagtaactaaaattccagaagatattctccagcttttatcaaaatacaactcaaacctagctactccaatagcaattaaagcagtgccacccagtaaaaggttccttaaacatggacagaacatccgagatgtcagcaacaaagaaaactgaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggactattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaacagagggagatttccaggcctgggtaactatatactgtgaccattggcggttgagaccggtcttcaaccagtggaaccccgaactctgctgtcagggtgtggacttcggtgctcttccaagttttcacctgggggggggagctaaccccctatgttcacgccttctattcccattggcgctgaactcttaaggtcactctggtcgcttgtgaccccgtaaccctgatgtacccctctaaaaggtgaggggc

SEQ ID NO: 1309 - protein, 330 aa, Unknown Organism
  Description of Unknown Organism: 193P1E1B v.1 variant amino acid sequence
MEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQLLSKYNSNLATPIAIKAVPPSKRFLKHGQNIRDVSNKEN

SEQ ID NO: 1310 - protein, 330 aa, Unknown Organism
  Description of Unknown Organism: 193P1E1B v.3 variant amino acid sequence
MEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDAESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQLLSKYNSNLATPIAIKAVPPSKRFLKHGQNIRDVSNKEN

SEQ ID NO: 1311 - DNA, 2679 bp, Unknown Organism
  Description of Unknown Organism: 193P1E1B v.4 cDNA sequence
  CDS (805)..(1968)
tatcatctgtgactgaggaaatccctatcttcctatcagactaatgaaaccacaggacagcaattagacttttaagtattggggggtttagagctctagatattcgatatgcagactactcatgtttgtttgttttaataaagactggtccaaaggctcattttcacacaagctacagtttttcagttccaggaccaggtaaagatggtcagctccgtgatccataaaatccaagggtgacgactcaggattaggaccatttcttggtgacattgagatggtcgagctggtccgcaatgaatctatgcggggggaacttggaagtggcggccgcctttatggcctcgaaggcctccctcctgcgcaccgcggcgtggccgcgctcctgctcccgggtcatgtagggcatgctcagccagtaatggttctccgcctcgatctccaggcggcggatcatgttctgcttggcgcgcaacgacacgaaccgcggccgccggtgcttcccgatccactgacggccgggaatgcggccgcgccagaggagcgcagtcaggaacatggtgcctgccgcgctgctcaagactctgcgtctccgcggccgccagcagacgccgtggcgtaagcgcacccgtctcgcggggtctccgggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccagaagtaactaaaattccagaagatattctccagaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggactattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaacagagggagatttccaggcctgggtaactatatactgtgaccattggcggttgagaccggtcttcaaccagtggaaccccgaactctgctgtcagggtgtggacttcggtgctcttccaagttttcacctgggggggggagctaaccccctatgttcacgccttctattcccattggcgctgaactcttaaggtcactctggtcgcttgtgaccccgtaaccctgatgtacccctctaaaaggtgaggggc

SEQ ID NO: 1312 - protein, 373 aa, Unknown Organism
  Description of Unknown Organism: 193P1E1B v.1 variant amino acid sequence
MDPIRSFCGKLRSLASTLDCETARLQRALDGEESDFEDYPMRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQ

SEQ ID NO: 1313 - protein, 388 aa, Unknown Organism
  Description of Unknown Organism: 193P1E1B v.4 variant amino acid sequence
MDPIRSFCGKLRSLASTLDCETARLQRALDGEESDFEDYPMRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQKFQWIYPTQKLNKMR

SEQ ID NO: 1314 - DNA, 2617 bp, Unknown Organism
  Description of Unknown Organism: 193P1E1B v.5 cDNA sequence
  CDS (989)..(1906)
tatcatctgtgactgaggaaatccctatcttcctatcagactaatgaaaccacaggacagcaattagacttttaagtattggggggtttagagctctagatattcgatatgcagactactcatgtttgtttgttttaataaagactggtccaaaggctcattttcacacaagctacagtttttcagttccaggaccaggtaaagatggtcagctccgtgatccataaaatccaagggtgacgactcaggattaggaccatttcttggtgacattgagatggtcgagctggtccgcaatgaatctatgcggggggaacttggaagtggcggccgcctttatggcctcgaaggcctccctcctgcgcaccgcggcgtggccgcgctcctgctcccgggtcatgtagggcatgctcagccagtaatggttctccgcctcgatctccaggcggcggatcatgttctgcttggcgcgcaacgacacgaaccgcggccgccggtgcttcccgatccactgacggccgggaatgcggccgcgccagaggagcgcagtcaggaacatggtgcctgccgcgctgctcaagactctgcgtctccgcggccgccagcagacgccgtggcgtaagcgcacccgtctcgcggggtctccgggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccagaagtaactaaaattccagaagatattctccagaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggactattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaacagagggagatttccaggcctgggtaactatatactgtgaccattggcggttgagaccggtcttcaaccagtggaaccccgaactctgctgtcagggtgtggacttcggtgctcttccaagttttcacctgggggggggagctaaccccctatgttcacgccttctattcccattggcgctgaactcttaaggtcactctggtcgcttgtgaccccgtaaccctgatgtacccctctaaaaggtgaggggc

SEQ ID NO: 1315 - protein, 306 aa, Unknown Organism
  Description of Unknown Organism: 193P1E1B v.5 variant amino acid sequence
MEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQKFQWIYPTQKLNKMR

SEQ ID NO: 1316 - DNA, 1781 bp, Unknown Organism
  Description of Unknown Organism: 193P1E1B v.6 cDNA sequence
  CDS (805)..(1023)
tatcatctgtgactgaggaaatccctatcttcctatcagactaatgaaaccacaggacagcaattagacttttaagtattggggggtttagagctctagatattcgatatgcagactactcatgtttgtttgttttaataaagactggtccaaaggctcattttcacacaagctacagtttttcagttccaggaccaggtaaagatggtcagctccgtgatccataaaatccaagggtgacgactcaggattaggaccatttcttggtgacattgagatggtcgagctggtccgcaatgaatctatgcggggggaacttggaagtggcggccgcctttatggcctcgaaggcctccctcctgcgcaccgcggcgtggccgcgctcctgctcccgggtcatgtagggcatgctcagccagtaatggttctccgcctcgatctccaggcggcggatcatgttctgcttggcgcgcaacgacacgaaccgcggccgccggtgcttcccgatccactgacggccgggaatgcggccgcgccagaggagcgcagtcaggaacatggtgcctgccgcgctgctcaagactctgcgtctccgcggccgccagcagacgccgtggcgtaagcgcacccgtctcgcggggtctccgggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagccttttatcaaaatacaactcaaacctagctactccaatagcaattaaagcagtgccacccagtaaaaggttccttaaacatggacagaacatccgagatgtcagcaacaaagaaaactgaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggactattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaacagagggagatttccaggcctgggtaactatatactgtgaccattggcggttgagaccggtcttcaaccagtggaaccccgaactctgctgtcagggtgtggacttcggtgctcttccaagttttcacctgggggggggagctaaccccctatgttcacgccttctattcccattggcgctgaactcttaaggtcactctggtcgcttgtgaccccgtaaccctgatgtacccctctaaaaggtgaggggc

SEQ ID NO: 1317 - protein, 73 aa, Unknown Organism
  Description of Unknown Organism: 193P1E1B v.6 variant amino acid seqeucne
MDPIRSFCGKLRSLASTLDCETARLQRALDGEESLLSKYNSNLATPIAIKAVPPSKRFLKHGQNIRDVSNKEN

SEQ ID NO: 1318 - protein, 9 aa, Homo sapiens
ILYDLHSEV

SEQ ID NO: 1319 - protein, 9 aa, Homo sapiens
KIPEDILQL

SEQ ID NO: 1320 - protein, 9 aa, Homo sapiens
DLHSEVQTL

SEQ ID NO: 1321 - protein, 9 aa, Homo sapiens
TLKDDVNIL

SEQ ID NO: 1322 - protein, 9 aa, Homo sapiens
KLRSLASTL

SEQ ID NO: 1323 - protein, 9 aa, Homo sapiens
TLDCETARL

SEQ ID NO: 1324 - protein, 9 aa, Homo sapiens
GISEYTMCL

SEQ ID NO: 1325 - protein, 9 aa, Homo sapiens
VLPNPPQAV

SEQ ID NO: 1326 - protein, 9 aa, Homo sapiens
ALVSTNYPL

SEQ ID NO: 1327 - protein, 9 aa, Homo sapiens
LLSKYNSNL

SEQ ID NO: 1328 - protein, 9 aa, Homo sapiens
NILLDKARL

SEQ ID NO: 1329 - protein, 9 aa, Homo sapiens
VLKTPKCAL

SEQ ID NO: 1330 - protein, 9 aa, Homo sapiens
SFCGKLRSL

SEQ ID NO: 1331 - protein, 9 aa, Homo sapiens
RLNDNVFAT

SEQ ID NO: 1332 - protein, 9 aa, Homo sapiens
STKNSIALV

SEQ ID NO: 1333 - protein, 9 aa, Homo sapiens
KIPSTKNSI

SEQ ID NO: 1334 - protein, 9 aa, Homo sapiens
TISSYENLL

SEQ ID NO: 1335 - protein, 9 aa, Homo sapiens
ATPIAIKAV

SEQ ID NO: 1336 - protein, 9 aa, Homo sapiens
GLERYIVSQ

SEQ ID NO: 1337 - protein, 9 aa, Homo sapiens
VTPPTKQSL

SEQ ID NO: 1338 - protein, 9 aa, Homo sapiens
LTDPSSPTI

SEQ ID NO: 1339 - protein, 9 aa, Homo sapiens
NLATPIAIK

SEQ ID NO: 1340 - protein, 9 aa, Homo sapiens
PIRSFCGKL

SEQ ID NO: 1341 - protein, 9 aa, Homo sapiens
SLASTLDCE

SEQ ID NO: 1342 - protein, 9 aa, Homo sapiens
YPMRILYDL

SEQ ID NO: 1343 - protein, 9 aa, Homo sapiens
PTKQSLVKV

SEQ ID NO: 1344 - protein, 9 aa, Homo sapiens
YTNSPLVPT

SEQ ID NO: 1345 - protein, 9 aa, Homo sapiens
AVPPSKRFL

SEQ ID NO: 1346 - protein, 9 aa, Homo sapiens
LMEKNSMDI

SEQ ID NO: 1347 - protein, 9 aa, Homo sapiens
SLVKVLKTP

SEQ ID NO: 1348 - protein, 9 aa, Homo sapiens
STNYPLSKT

SEQ ID NO: 1349 - protein, 9 aa, Homo sapiens
KTNSSSNDL

SEQ ID NO: 1350 - protein, 9 aa, Homo sapiens
PTPPEVTKI

SEQ ID NO: 1351 - protein, 9 aa, Homo sapiens
RILYDLHSE

SEQ ID NO: 1352 - protein, 9 aa, Homo sapiens
QTLKDDVNI

SEQ ID NO: 1353 - protein, 9 aa, Homo sapiens
ILLDKARLE

SEQ ID NO: 1354 - protein, 9 aa, Homo sapiens
IDFIKATKV

SEQ ID NO: 1355 - protein, 9 aa, Homo sapiens
SPRVKKNSV

SEQ ID NO: 1356 - protein, 9 aa, Homo sapiens
EAINSDPEL

SEQ ID NO: 1357 - protein, 9 aa, Homo sapiens
LNEDYTMGL

SEQ ID NO: 1358 - protein, 9 aa, Homo sapiens
TPSPIIQQL

SEQ ID NO: 1359 - protein, 9 aa, Homo sapiens
LEVEDRTSL

SEQ ID NO: 1360 - protein, 9 aa, Homo sapiens
LLRTPTPPE

SEQ ID NO: 1361 - protein, 9 aa, Homo sapiens
LRTPTPPEV

SEQ ID NO: 1362 - protein, 9 aa, Homo sapiens
IPEDILQLL

SEQ ID NO: 1363 - protein, 9 aa, Homo sapiens
DILQLLSKY

SEQ ID NO: 1364 - protein, 9 aa, Homo sapiens
QLLSKYNSN

SEQ ID NO: 1365 - protein, 9 aa, Homo sapiens
GKLRSLAST

SEQ ID NO: 1366 - protein, 9 aa, Homo sapiens
ETARLQRAL

SEQ ID NO: 1367 - protein, 9 aa, Homo sapiens
RLQRALDGE

SEQ ID NO: 1368 - protein, 9 aa, Homo sapiens
DVNILLDKA

SEQ ID NO: 1369 - protein, 9 aa, Homo sapiens
LLDKARLEN

SEQ ID NO: 1370 - protein, 9 aa, Homo sapiens
ARLENQEGI

SEQ ID NO: 1371 - protein, 9 aa, Homo sapiens
VLMEKNSMD

SEQ ID NO: 1372 - protein, 9 aa, Homo sapiens
KNSMDIMKI

SEQ ID NO: 1373 - protein, 9 aa, Homo sapiens
QKYGYSPRV

SEQ ID NO: 1374 - protein, 9 aa, Homo sapiens
QLSDFGLER

SEQ ID NO: 1375 - protein, 9 aa, Homo sapiens
LERYIVSQV

SEQ ID NO: 1376 - protein, 9 aa, Homo sapiens
YIVSQVLPN

SEQ ID NO: 1377 - protein, 9 aa, Homo sapiens
KMDDFECVT

SEQ ID NO: 1378 - protein, 9 aa, Homo sapiens
NLTDPSSPT

SEQ ID NO: 1379 - protein, 9 aa, Homo sapiens
VTKIPEDIL

SEQ ID NO: 1380 - protein, 9 aa, Homo sapiens
KHGQNIRDV

SEQ ID NO: 1381 - protein, 9 aa, Homo sapiens
ALDGEESDF

SEQ ID NO: 1382 - protein, 9 aa, Homo sapiens
FIKATKVLM

SEQ ID NO: 1383 - protein, 9 aa, Homo sapiens
KVLMEKNSM

SEQ ID NO: 1384 - protein, 9 aa, Homo sapiens
KIREYFQKY

SEQ ID NO: 1385 - protein, 9 aa, Homo sapiens
DLSDPPVAS

SEQ ID NO: 1386 - protein, 9 aa, Homo sapiens
SDFGLERYI

SEQ ID NO: 1387 - protein, 9 aa, Homo sapiens
TKQSLVKVL

SEQ ID NO: 1388 - protein, 9 aa, Homo sapiens
QSLVKVLKT

SEQ ID NO: 1389 - protein, 9 aa, Homo sapiens
LKMDDFECV

SEQ ID NO: 1390 - protein, 9 aa, Homo sapiens
EAIDTESRL

SEQ ID NO: 1391 - protein, 9 aa, Homo sapiens
AEYTNSPLV

SEQ ID NO: 1392 - protein, 9 aa, Homo sapiens
SLVLNSDTC

SEQ ID NO: 1393 - protein, 9 aa, Homo sapiens
VLNSDTCFE

SEQ ID NO: 1394 - protein, 9 aa, Homo sapiens
SSYENLLRT

SEQ ID NO: 1395 - protein, 9 aa, Homo sapiens
LASTLDCET

SEQ ID NO: 1396 - protein, 9 aa, Homo sapiens
LKDDVNILL

SEQ ID NO: 1397 - protein, 9 aa, Homo sapiens
ENQEGIDFI

SEQ ID NO: 1398 - protein, 9 aa, Homo sapiens
LSDPPVASS

SEQ ID NO: 1399 - protein, 9 aa, Homo sapiens
SPQLSDFGL

SEQ ID NO: 1400 - protein, 9 aa, Homo sapiens
QVLPNPPQA

SEQ ID NO: 1401 - protein, 9 aa, Homo sapiens
NYKEEPVIV

SEQ ID NO: 1402 - protein, 9 aa, Homo sapiens
ALKMDDFEC

SEQ ID NO: 1403 - protein, 9 aa, Homo sapiens
DFECVTPKL

SEQ ID NO: 1404 - protein, 9 aa, Homo sapiens
KLEHFGISE

SEQ ID NO: 1405 - protein, 9 aa, Homo sapiens
CLNEDYTMG

SEQ ID NO: 1406 - protein, 9 aa, Homo sapiens
NVFATPSPI

SEQ ID NO: 1407 - protein, 9 aa, Homo sapiens
VFATPSPII

SEQ ID NO: 1408 - protein, 9 aa, Homo sapiens
PIIQQLEKS

SEQ ID NO: 1409 - protein, 9 aa, Homo sapiens
QLEKSDAEY

SEQ ID NO: 1410 - protein, 9 aa, Homo sapiens
VPTFCTPGL

SEQ ID NO: 1411 - protein, 9 aa, Homo sapiens
GLKIPSTKN

SEQ ID NO: 1412 - protein, 9 aa, Homo sapiens
KNSIALVST

SEQ ID NO: 1413 - protein, 9 aa, Homo sapiens
NSSSNDLEV

SEQ ID NO: 1414 - protein, 9 aa, Homo sapiens
EVEDRTSLV

SEQ ID NO: 1415 - protein, 9 aa, Homo sapiens
PTISSYENL

SEQ ID NO: 1416 - protein, 9 aa, Homo sapiens
SNLATPIAI

SEQ ID NO: 1417 - protein, 9 aa, Homo sapiens
LATPIAIKA

SEQ ID NO: 1418 - protein, 9 aa, Homo sapiens
IAIKAVPPS

SEQ ID NO: 1419 - protein, 9 aa, Homo sapiens
FLKHGQNIR

SEQ ID NO: 1420 - protein, 9 aa, Homo sapiens
LATPIAIKA

SEQ ID NO: 1421 - protein, 9 aa, Homo sapiens
ASTLDCETA

SEQ ID NO: 1422 - protein, 9 aa, Homo sapiens
ARNNKSEEA

SEQ ID NO: 1423 - protein, 9 aa, Homo sapiens
FCGKLRSLA

SEQ ID NO: 1424 - protein, 9 aa, Homo sapiens
CETARLQRA

SEQ ID NO: 1425 - protein, 9 aa, Homo sapiens
DVNILLDKA

SEQ ID NO: 1426 - protein, 9 aa, Homo sapiens
QEGIDFIKA

SEQ ID NO: 1427 - protein, 9 aa, Homo sapiens
KNSVHEQEA

SEQ ID NO: 1428 - protein, 9 aa, Homo sapiens
DDLSDPPVA

SEQ ID NO: 1429 - protein, 9 aa, Homo sapiens
QVLPNPPQA

SEQ ID NO: 1430 - protein, 9 aa, Homo sapiens
KVLKTPKCA

SEQ ID NO: 1431 - protein, 9 aa, Homo sapiens
DYTMGLKNA

SEQ ID NO: 1432 - protein, 9 aa, Homo sapiens
SRLNDNVFA

SEQ ID NO: 1433 - protein, 9 aa, Homo sapiens
IQQLEKSDA

SEQ ID NO: 1434 - protein, 9 aa, Homo sapiens
IPSTKNSIA

SEQ ID NO: 1435 - protein, 9 aa, Homo sapiens
LSKYNSNLA

SEQ ID NO: 1436 - protein, 9 aa, Homo sapiens
NSNLATPIA

SEQ ID NO: 1437 - protein, 9 aa, Homo sapiens
LSDFGLERY

SEQ ID NO: 1438 - protein, 9 aa, Homo sapiens
GEESDFEDY

SEQ ID NO: 1439 - protein, 9 aa, Homo sapiens
EDYPMRILY

SEQ ID NO: 1440 - protein, 9 aa, Homo sapiens
QLEKSDAEY

SEQ ID NO: 1441 - protein, 9 aa, Homo sapiens
HSEVQTLKD

SEQ ID NO: 1442 - protein, 9 aa, Homo sapiens
YTMCLNEDY

SEQ ID NO: 1443 - protein, 9 aa, Homo sapiens
PSSPTISSY

SEQ ID NO: 1444 - protein, 9 aa, Homo sapiens
KIREYFQKY

SEQ ID NO: 1445 - protein, 9 aa, Homo sapiens
LSDPPVASS

SEQ ID NO: 1446 - protein, 9 aa, Homo sapiens
LTDPSSPTI

SEQ ID NO: 1447 - protein, 9 aa, Homo sapiens
LKDDVNILL

SEQ ID NO: 1448 - protein, 9 aa, Homo sapiens
YKEEPVIVT

SEQ ID NO: 1449 - protein, 9 aa, Homo sapiens
SIALVSTNY

SEQ ID NO: 1450 - protein, 9 aa, Homo sapiens
KDDVNILLD

SEQ ID NO: 1451 - protein, 9 aa, Homo sapiens
LLDKARLEN

SEQ ID NO: 1452 - protein, 9 aa, Homo sapiens
NSDPELSNC

SEQ ID NO: 1453 - protein, 9 aa, Homo sapiens
KTDVKDDLS

SEQ ID NO: 1454 - protein, 9 aa, Homo sapiens
VEDRTSLVL

SEQ ID NO: 1455 - protein, 9 aa, Homo sapiens
PEDILQLLS

SEQ ID NO: 1456 - protein, 9 aa, Homo sapiens
DCETARLQR

SEQ ID NO: 1457 - protein, 9 aa, Homo sapiens
REYFQKYGY

SEQ ID NO: 1458 - protein, 9 aa, Homo sapiens
LEHFGISEY

SEQ ID NO: 1459 - protein, 9 aa, Homo sapiens
NSDTCFENL

SEQ ID NO: 1460 - protein, 9 aa, Homo sapiens
DILQLLSKY

SEQ ID NO: 1461 - protein, 9 aa, Homo sapiens
SMDIMKIRE

SEQ ID NO: 1462 - protein, 9 aa, Homo sapiens
NPPQAVNNY

SEQ ID NO: 1463 - protein, 9 aa, Homo sapiens
KEEPVIVTP

SEQ ID NO: 1464 - protein, 9 aa, Homo sapiens
KLEHFGISE

SEQ ID NO: 1465 - protein, 9 aa, Homo sapiens
ISEYTMCLN

SEQ ID NO: 1466 - protein, 9 aa, Homo sapiens
DTESRLNDN

SEQ ID NO: 1467 - protein, 9 aa, Homo sapiens
MDIMKIREY

SEQ ID NO: 1468 - protein, 9 aa, Homo sapiens
VHEQEAINS

SEQ ID NO: 1469 - protein, 9 aa, Homo sapiens
LNDNVFATP

SEQ ID NO: 1470 - protein, 9 aa, Homo sapiens
DILQLLSKY

SEQ ID NO: 1471 - protein, 9 aa, Homo sapiens
DLHSEVQTL

SEQ ID NO: 1472 - protein, 9 aa, Homo sapiens
KIREYFQKY

SEQ ID NO: 1473 - protein, 9 aa, Homo sapiens
CVTPKLEHF

SEQ ID NO: 1474 - protein, 9 aa, Homo sapiens
ETARLQRAL

SEQ ID NO: 1475 - protein, 9 aa, Homo sapiens
DIMKIREYF

SEQ ID NO: 1476 - protein, 9 aa, Homo sapiens
PTISSYENL

SEQ ID NO: 1477 - protein, 9 aa, Homo sapiens
KIPEDILQL

SEQ ID NO: 1478 - protein, 9 aa, Homo sapiens
DFIKATKVL

SEQ ID NO: 1479 - protein, 9 aa, Homo sapiens
DVKDDLSDP

SEQ ID NO: 1480 - protein, 9 aa, Homo sapiens
VTPPTKQSL

SEQ ID NO: 1481 - protein, 9 aa, Homo sapiens
SFCGKLRSL

SEQ ID NO: 1482 - protein, 9 aa, Homo sapiens
ALDGEESDF

SEQ ID NO: 1483 - protein, 9 aa, Homo sapiens
TLKDDVNIL

SEQ ID NO: 1484 - protein, 9 aa, Homo sapiens
DVNILLDKA

SEQ ID NO: 1485 - protein, 9 aa, Homo sapiens
DFECVTPKL

SEQ ID NO: 1486 - protein, 9 aa, Homo sapiens
QLEKSDAEY

SEQ ID NO: 1487 - protein, 9 aa, Homo sapiens
SIALVSTNY

SEQ ID NO: 1488 - protein, 9 aa, Homo sapiens
AVPPSKRFL

SEQ ID NO: 1489 - protein, 9 aa, Homo sapiens
KTPKCALKM

SEQ ID NO: 1490 - protein, 9 aa, Homo sapiens
GISEYTMCL

SEQ ID NO: 1491 - protein, 9 aa, Homo sapiens
YTMCLNEDY

SEQ ID NO: 1492 - protein, 9 aa, Homo sapiens
DTESRLNDN

SEQ ID NO: 1493 - protein, 9 aa, Homo sapiens
LVLNSDTCF

SEQ ID NO: 1494 - protein, 9 aa, Homo sapiens
PIRSFCGKL

SEQ ID NO: 1495 - protein, 9 aa, Homo sapiens
NILLDKARL

SEQ ID NO: 1496 - protein, 9 aa, Homo sapiens
FIKATKVLM

SEQ ID NO: 1497 - protein, 9 aa, Homo sapiens
KTNSSSNDL

SEQ ID NO: 1498 - protein, 9 aa, Homo sapiens
KLRSLASTL

SEQ ID NO: 1499 - protein, 9 aa, Homo sapiens
TLDCETARL

SEQ ID NO: 1500 - protein, 9 aa, Homo sapiens
KVLMEKNSM

SEQ ID NO: 1501 - protein, 9 aa, Homo sapiens
EAINSDPEL

SEQ ID NO: 1502 - protein, 9 aa, Homo sapiens
PTKQSLVKV

SEQ ID NO: 1503 - protein, 9 aa, Homo sapiens
EAIDTESRL

SEQ ID NO: 1504 - protein, 9 aa, Homo sapiens
PIIQQLEKS

SEQ ID NO: 1505 - protein, 9 aa, Homo sapiens
TISSYENLL

SEQ ID NO: 1506 - protein, 9 aa, Homo sapiens
VTKIPEDIL

SEQ ID NO: 1507 - protein, 9 aa, Homo sapiens
LLSKYNSNL

SEQ ID NO: 1508 - protein, 9 aa, Homo sapiens
EDYPMRILY

SEQ ID NO: 1509 - protein, 9 aa, Homo sapiens
MDIMKIREY

SEQ ID NO: 1510 - protein, 9 aa, Homo sapiens
EKSPRSPQL

SEQ ID NO: 1511 - protein, 9 aa, Homo sapiens
PRSPQLSDF

SEQ ID NO: 1512 - protein, 9 aa, Homo sapiens
VLKTPKCAL

SEQ ID NO: 1513 - protein, 9 aa, Homo sapiens
TNSPLVPTF

SEQ ID NO: 1514 - protein, 9 aa, Homo sapiens
EVEDRTSLV

SEQ ID NO: 1515 - protein, 9 aa, Homo sapiens
PSSPTISSY

SEQ ID NO: 1516 - protein, 9 aa, Homo sapiens
PTPPEVTKI

SEQ ID NO: 1517 - protein, 9 aa, Homo sapiens
EVQTLKDDV

SEQ ID NO: 1518 - protein, 9 aa, Homo sapiens
ATKVLMEKN

SEQ ID NO: 1519 - protein, 9 aa, Homo sapiens
DLSDPPVAS

SEQ ID NO: 1520 - protein, 9 aa, Homo sapiens
IVSQVLPNP

SEQ ID NO: 1521 - protein, 9 aa, Homo sapiens
NPPQAVNNY

SEQ ID NO: 1522 - protein, 9 aa, Homo sapiens
ATPSPIIQQ

SEQ ID NO: 1523 - protein, 9 aa, Homo sapiens
STKNSIALV

SEQ ID NO: 1524 - protein, 9 aa, Homo sapiens
ALVSTNYPL

SEQ ID NO: 1525 - protein, 9 aa, Homo sapiens
EVTKIPEDI

SEQ ID NO: 1526 - protein, 9 aa, Homo sapiens
PVIVTPPTK

SEQ ID NO: 1527 - protein, 9 aa, Homo sapiens
AIKAVPPSK

SEQ ID NO: 1528 - protein, 9 aa, Homo sapiens
KLRSLASTL

SEQ ID NO: 1529 - protein, 9 aa, Homo sapiens
GIDFIKATK

SEQ ID NO: 1530 - protein, 9 aa, Homo sapiens
NLATPIAIK

SEQ ID NO: 1531 - protein, 9 aa, Homo sapiens
QLSDFGLER

SEQ ID NO: 1532 - protein, 9 aa, Homo sapiens
GLKNARNNK

SEQ ID NO: 1533 - protein, 9 aa, Homo sapiens
ALDGEESDF

SEQ ID NO: 1534 - protein, 9 aa, Homo sapiens
LVKVLKTPK

SEQ ID NO: 1535 - protein, 9 aa, Homo sapiens
KIREYFQKY

SEQ ID NO: 1536 - protein, 9 aa, Homo sapiens
QVLPNPPQA

SEQ ID NO: 1537 - protein, 9 aa, Homo sapiens
QLEKSDAEY

SEQ ID NO: 1538 - protein, 9 aa, Homo sapiens
TPTPPEVTK

SEQ ID NO: 1539 - protein, 9 aa, Homo sapiens
QNIRDVSNK

SEQ ID NO: 1540 - protein, 9 aa, Homo sapiens
ILYDLHSEV

SEQ ID NO: 1541 - protein, 9 aa, Homo sapiens
PGLKIPSTK

SEQ ID NO: 1542 - protein, 9 aa, Homo sapiens
ILLDKARLE

SEQ ID NO: 1543 - protein, 9 aa, Homo sapiens
MKIREYFQK

SEQ ID NO: 1544 - protein, 9 aa, Homo sapiens
YGYSPRVKK

SEQ ID NO: 1545 - protein, 9 aa, Homo sapiens
RVKKNSVHE

SEQ ID NO: 1546 - protein, 9 aa, Homo sapiens
GLERYIVSQ

SEQ ID NO: 1547 - protein, 9 aa, Homo sapiens
KQSLVKVLK

SEQ ID NO: 1548 - protein, 9 aa, Homo sapiens
SIALVSTNY

SEQ ID NO: 1549 - protein, 9 aa, Homo sapiens
EDILQLLSK

SEQ ID NO: 1550 - protein, 9 aa, Homo sapiens
DILQLLSKY

SEQ ID NO: 1551 - protein, 9 aa, Homo sapiens
KYGYSPRVK

SEQ ID NO: 1552 - protein, 9 aa, Homo sapiens
IVTPPTKQS

SEQ ID NO: 1553 - protein, 9 aa, Homo sapiens
CVTPKLEHF

SEQ ID NO: 1554 - protein, 9 aa, Homo sapiens
KLEHFGISE

SEQ ID NO: 1555 - protein, 9 aa, Homo sapiens
SPIIQQLEK

SEQ ID NO: 1556 - protein, 9 aa, Homo sapiens
LVLNSDTCF

SEQ ID NO: 1557 - protein, 9 aa, Homo sapiens
KIPEDILQL

SEQ ID NO: 1558 - protein, 9 aa, Homo sapiens
PIAIKAVPP

SEQ ID NO: 1559 - protein, 9 aa, Homo sapiens
RLQRALDGE

SEQ ID NO: 1560 - protein, 9 aa, Homo sapiens
KVLMEKNSM

SEQ ID NO: 1561 - protein, 9 aa, Homo sapiens
DLSDPPVAS

SEQ ID NO: 1562 - protein, 9 aa, Homo sapiens
PPTKQSLVK

SEQ ID NO: 1563 - protein, 9 aa, Homo sapiens
LKTPKCALK

SEQ ID NO: 1564 - protein, 9 aa, Homo sapiens
PLVPTFCTP

SEQ ID NO: 1565 - protein, 9 aa, Homo sapiens
VSTNYPLSK

SEQ ID NO: 1566 - protein, 9 aa, Homo sapiens
NLLRTPTPP

SEQ ID NO: 1567 - protein, 9 aa, Homo sapiens
QLLSKYNSN

SEQ ID NO: 1568 - protein, 9 aa, Homo sapiens
FLKHGQNIR

SEQ ID NO: 1569 - protein, 9 aa, Homo sapiens
DPIRSFCGK

SEQ ID NO: 1570 - protein, 9 aa, Homo sapiens
RILYDLHSE

SEQ ID NO: 1571 - protein, 9 aa, Homo sapiens
RLENQEGID

SEQ ID NO: 1572 - protein, 9 aa, Homo sapiens
VLMEKNSMD

SEQ ID NO: 1573 - protein, 9 aa, Homo sapiens
SLVKVLKTP

SEQ ID NO: 1574 - protein, 9 aa, Homo sapiens
KVLKTPKCA

SEQ ID NO: 1575 - protein, 9 aa, Homo sapiens
RLNDNVFAT

SEQ ID NO: 1576 - protein, 9 aa, Homo sapiens
NVFATPSPI

SEQ ID NO: 1577 - protein, 9 aa, Homo sapiens
EVEDRTSLV

SEQ ID NO: 1578 - protein, 9 aa, Homo sapiens
SLVLNSDTC

SEQ ID NO: 1579 - protein, 9 aa, Homo sapiens
AVPPSKRFL

SEQ ID NO: 1580 - protein, 9 aa, Homo sapiens
FIKATKVLM

SEQ ID NO: 1581 - protein, 9 aa, Homo sapiens
KATKVLMEK

SEQ ID NO: 1582 - protein, 9 aa, Homo sapiens
SVHEQEAIN

SEQ ID NO: 1583 - protein, 9 aa, Homo sapiens
ENFQKTDVK

SEQ ID NO: 1584 - protein, 9 aa, Homo sapiens
DVKDDLSDP

SEQ ID NO: 1585 - protein, 9 aa, Homo sapiens
KEEPVIVTP

SEQ ID NO: 1586 - protein, 9 aa, Homo sapiens
PLSKTNSSS

SEQ ID NO: 1587 - protein, 9 aa, Homo sapiens
EDYPMRILY

SEQ ID NO: 1588 - protein, 9 aa, Homo sapiens
DLHSEVQTL

SEQ ID NO: 1589 - protein, 9 aa, Homo sapiens
DDVNILLDK

SEQ ID NO: 1590 - protein, 9 aa, Homo sapiens
NILLDKARL

SEQ ID NO: 1591 - protein, 9 aa, Homo sapiens
LLDKARLEN

SEQ ID NO: 1592 - protein, 9 aa, Homo sapiens
REYFQKYGY

SEQ ID NO: 1593 - protein, 9 aa, Homo sapiens
AVNNYKEEP

SEQ ID NO: 1594 - protein, 9 aa, Homo sapiens
ALKMDDFEC

SEQ ID NO: 1595 - protein, 9 aa, Homo sapiens
DLEVEDRTS

SEQ ID NO: 1596 - protein, 9 aa, Homo sapiens
NLTDPSSPT

SEQ ID NO: 1597 - protein, 9 aa, Homo sapiens
PSSPTISSY

SEQ ID NO: 1598 - protein, 9 aa, Homo sapiens
TPSPIIQQL

SEQ ID NO: 1599 - protein, 9 aa, Homo sapiens
VPTFCTPGL

SEQ ID NO: 1600 - protein, 9 aa, Homo sapiens
YPMRILYDL

SEQ ID NO: 1601 - protein, 9 aa, Homo sapiens
IPEDILQLL

SEQ ID NO: 1602 - protein, 9 aa, Homo sapiens
SPQLSDFGL

SEQ ID NO: 1603 - protein, 9 aa, Homo sapiens
EPVIVTPPT

SEQ ID NO: 1604 - protein, 9 aa, Homo sapiens
SPLVPTFCT

SEQ ID NO: 1605 - protein, 9 aa, Homo sapiens
IPSTKNSIA

SEQ ID NO: 1606 - protein, 9 aa, Homo sapiens
SPRVKKNSV

SEQ ID NO: 1607 - protein, 9 aa, Homo sapiens
TPGLKIPST

SEQ ID NO: 1608 - protein, 9 aa, Homo sapiens
SPRSPQLSD

SEQ ID NO: 1609 - protein, 9 aa, Homo sapiens
DPPVASSCI

SEQ ID NO: 1610 - protein, 9 aa, Homo sapiens
LPNPPQAVN

SEQ ID NO: 1611 - protein, 9 aa, Homo sapiens
TPPTKQSLV

SEQ ID NO: 1612 - protein, 9 aa, Homo sapiens
TPKLEHFGI

SEQ ID NO: 1613 - protein, 9 aa, Homo sapiens
DPSSPTISS

SEQ ID NO: 1614 - protein, 9 aa, Homo sapiens
TPTPPEVTK

SEQ ID NO: 1615 - protein, 9 aa, Homo sapiens
PPSKRFLKH

SEQ ID NO: 1616 - protein, 9 aa, Homo sapiens
EKSPRSPQL

SEQ ID NO: 1617 - protein, 9 aa, Homo sapiens
FEDYPMRIL

SEQ ID NO: 1618 - protein, 9 aa, Homo sapiens
PPTKQSLVK

SEQ ID NO: 1619 - protein, 9 aa, Homo sapiens
VLKTPKCAL

SEQ ID NO: 1620 - protein, 9 aa, Homo sapiens
VEDRTSLVL

SEQ ID NO: 1621 - protein, 9 aa, Homo sapiens
AVPPSKRFL

SEQ ID NO: 1622 - protein, 9 aa, Homo sapiens
KLRSLASTL

SEQ ID NO: 1623 - protein, 9 aa, Homo sapiens
TLDCETARL

SEQ ID NO: 1624 - protein, 9 aa, Homo sapiens
ETARLQRAL

SEQ ID NO: 1625 - protein, 9 aa, Homo sapiens
DFIKATKVL

SEQ ID NO: 1626 - protein, 9 aa, Homo sapiens
GISEYTMCL

SEQ ID NO: 1627 - protein, 9 aa, Homo sapiens
ALVSTNYPL

SEQ ID NO: 1628 - protein, 9 aa, Homo sapiens
VTKIPEDIL

SEQ ID NO: 1629 - protein, 9 aa, Homo sapiens
KIPEDILQL

SEQ ID NO: 1630 - protein, 9 aa, Homo sapiens
LLSKYNSNL

SEQ ID NO: 1631 - protein, 9 aa, Homo sapiens
TPIAIKAVP

SEQ ID NO: 1632 - protein, 9 aa, Homo sapiens
PIRSFCGKL

SEQ ID NO: 1633 - protein, 9 aa, Homo sapiens
SFCGKLRSL

SEQ ID NO: 1634 - protein, 9 aa, Homo sapiens
EAINSDPEL

SEQ ID NO: 1635 - protein, 9 aa, Homo sapiens
ERYIVSQVL

SEQ ID NO: 1636 - protein, 9 aa, Homo sapiens
TKQSLVKVL

SEQ ID NO: 1637 - protein, 9 aa, Homo sapiens
DFECVTPKL

SEQ ID NO: 1638 - protein, 9 aa, Homo sapiens
SPIIQQLEK

SEQ ID NO: 1639 - protein, 9 aa, Homo sapiens
YTNSPLVPT

SEQ ID NO: 1640 - protein, 9 aa, Homo sapiens
TFCTPGLKI

SEQ ID NO: 1641 - protein, 9 aa, Homo sapiens
PSTKNSIAL

SEQ ID NO: 1642 - protein, 9 aa, Homo sapiens
LEVEDRTSL

SEQ ID NO: 1643 - protein, 9 aa, Homo sapiens
NSDTCFENL

SEQ ID NO: 1644 - protein, 9 aa, Homo sapiens
TISSYENLL

SEQ ID NO: 1645 - protein, 9 aa, Homo sapiens
DPIRSFCGK

SEQ ID NO: 1646 - protein, 9 aa, Homo sapiens
ALDGEESDF

SEQ ID NO: 1647 - protein, 9 aa, Homo sapiens
DLHSEVQTL

SEQ ID NO: 1648 - protein, 9 aa, Homo sapiens
TLKDDVNIL

SEQ ID NO: 1649 - protein, 9 aa, Homo sapiens
LKDDVNILL

SEQ ID NO: 1650 - protein, 9 aa, Homo sapiens
NILLDKARL

SEQ ID NO: 1651 - protein, 9 aa, Homo sapiens
PPVASSCIS

SEQ ID NO: 1652 - protein, 9 aa, Homo sapiens
NPPQAVNNY

SEQ ID NO: 1653 - protein, 9 aa, Homo sapiens
PPQAVNNYK

SEQ ID NO: 1654 - protein, 9 aa, Homo sapiens
YKEEPVIVT

SEQ ID NO: 1655 - protein, 9 aa, Homo sapiens
VTPPTKQSL

SEQ ID NO: 1656 - protein, 9 aa, Homo sapiens
LNEDYTMGL

SEQ ID NO: 1657 - protein, 9 aa, Homo sapiens
EAIDTESRL

SEQ ID NO: 1658 - protein, 9 aa, Homo sapiens
VFATPSPII

SEQ ID NO: 1659 - protein, 9 aa, Homo sapiens
DAEYTNSPL

SEQ ID NO: 1660 - protein, 9 aa, Homo sapiens
TNSPLVPTF

SEQ ID NO: 1661 - protein, 9 aa, Homo sapiens
KNSIALVST

SEQ ID NO: 1662 - protein, 9 aa, Homo sapiens
YPLSKTNSS

SEQ ID NO: 1663 - protein, 9 aa, Homo sapiens
KTNSSSNDL

SEQ ID NO: 1664 - protein, 9 aa, Homo sapiens
RTPTPPEVT

SEQ ID NO: 1665 - protein, 9 aa, Homo sapiens
TPPEVTKIP

SEQ ID NO: 1666 - protein, 9 aa, Homo sapiens
PPEVTKIPE

SEQ ID NO: 1667 - protein, 9 aa, Homo sapiens
KAVPPSKRF

SEQ ID NO: 1668 - protein, 9 aa, Homo sapiens
VPPSKRFLK

SEQ ID NO: 1669 - protein, 9 aa, Homo sapiens
VLKTPKCAL

SEQ ID NO: 1670 - protein, 9 aa, Homo sapiens
TLKDDVNIL

SEQ ID NO: 1671 - protein, 9 aa, Homo sapiens
SPRVKKNSV

SEQ ID NO: 1672 - protein, 9 aa, Homo sapiens
TPKLEHFGI

SEQ ID NO: 1673 - protein, 9 aa, Homo sapiens
SFCGKLRSL

SEQ ID NO: 1674 - protein, 9 aa, Homo sapiens
KLRSLASTL

SEQ ID NO: 1675 - protein, 9 aa, Homo sapiens
VTKIPEDIL

SEQ ID NO: 1676 - protein, 9 aa, Homo sapiens
PIRSFCGKL

SEQ ID NO: 1677 - protein, 9 aa, Homo sapiens
CGKLRSLAS

SEQ ID NO: 1678 - protein, 9 aa, Homo sapiens
VLMEKNSMD

SEQ ID NO: 1679 - protein, 9 aa, Homo sapiens
EKSPRSPQL

SEQ ID NO: 1680 - protein, 9 aa, Homo sapiens
IMKIREYFQ

SEQ ID NO: 1681 - protein, 9 aa, Homo sapiens
SPQLSDFGL

SEQ ID NO: 1682 - protein, 9 aa, Homo sapiens
LDKARLENQ

SEQ ID NO: 1683 - protein, 9 aa, Homo sapiens
TPGLKIPST

SEQ ID NO: 1684 - protein, 9 aa, Homo sapiens
IPSTKNSIA

SEQ ID NO: 1685 - protein, 9 aa, Homo sapiens
DLHSEVQTL

SEQ ID NO: 1686 - protein, 9 aa, Homo sapiens
ILLDKARLE

SEQ ID NO: 1687 - protein, 9 aa, Homo sapiens
EAINSDPEL

SEQ ID NO: 1688 - protein, 9 aa, Homo sapiens
TPKCALKMD

SEQ ID NO: 1689 - protein, 9 aa, Homo sapiens
KCALKMDDF

SEQ ID NO: 1690 - protein, 9 aa, Homo sapiens
ALKMDDFEC

SEQ ID NO: 1691 - protein, 9 aa, Homo sapiens
GISEYTMCL

SEQ ID NO: 1692 - protein, 9 aa, Homo sapiens
GLKNARNNK

SEQ ID NO: 1693 - protein, 9 aa, Homo sapiens
TPSPIIQQL

SEQ ID NO: 1694 - protein, 9 aa, Homo sapiens
VPTFCTPGL

SEQ ID NO: 1695 - protein, 9 aa, Homo sapiens
GLKIPSTKN

SEQ ID NO: 1696 - protein, 9 aa, Homo sapiens
ALVSTNYPL

SEQ ID NO: 1697 - protein, 9 aa, Homo sapiens
KIPEDILQL

SEQ ID NO: 1698 - protein, 9 aa, Homo sapiens
IPEDILQLL

SEQ ID NO: 1699 - protein, 9 aa, Homo sapiens
LLSKYNSNL

SEQ ID NO: 1700 - protein, 9 aa, Homo sapiens
VPPSKRFLK

SEQ ID NO: 1701 - protein, 9 aa, Homo sapiens
FLKHGQNIR

SEQ ID NO: 1702 - protein, 9 aa, Homo sapiens
TLDCETARL

SEQ ID NO: 1703 - protein, 9 aa, Homo sapiens
YPMRILYDL

SEQ ID NO: 1704 - protein, 9 aa, Homo sapiens
FIKATKVLM

SEQ ID NO: 1705 - protein, 9 aa, Homo sapiens
CISEKSPRS

SEQ ID NO: 1706 - protein, 9 aa, Homo sapiens
TPPTKQSLV

SEQ ID NO: 1707 - protein, 9 aa, Homo sapiens
CVTPKLEHF

SEQ ID NO: 1708 - protein, 9 aa, Homo sapiens
EAIDTESRL

SEQ ID NO: 1709 - protein, 9 aa, Homo sapiens
DAEYTNSPL

SEQ ID NO: 1710 - protein, 9 aa, Homo sapiens
YPLSKTNSS

SEQ ID NO: 1711 - protein, 9 aa, Homo sapiens
QLLSKYNSN

SEQ ID NO: 1712 - protein, 9 aa, Homo sapiens
NILLDKARL

SEQ ID NO: 1713 - protein, 9 aa, Homo sapiens
ESRLNDNVF

SEQ ID NO: 1714 - protein, 9 aa, Homo sapiens
PIAIKAVPP

SEQ ID NO: 1715 - protein, 9 aa, Homo sapiens
SPRSPQLSD

SEQ ID NO: 1716 - protein, 9 aa, Homo sapiens
TISSYENLL

SEQ ID NO: 1717 - protein, 9 aa, Homo sapiens
AIKAVPPSK

SEQ ID NO: 1718 - protein, 9 aa, Homo sapiens
PPSKRFLKH

SEQ ID NO: 1719 - protein, 9 aa, Homo sapiens
ETARLQRAL

SEQ ID NO: 1720 - protein, 9 aa, Homo sapiens
EKSPRSPQL

SEQ ID NO: 1721 - protein, 9 aa, Homo sapiens
TPSPIIQQL

SEQ ID NO: 1722 - protein, 9 aa, Homo sapiens
AVPPSKRFL

SEQ ID NO: 1723 - protein, 9 aa, Homo sapiens
KHGQNIRDV

SEQ ID NO: 1724 - protein, 9 aa, Homo sapiens
FEDYPMRIL

SEQ ID NO: 1725 - protein, 9 aa, Homo sapiens
TKQSLVKVL

SEQ ID NO: 1726 - protein, 9 aa, Homo sapiens
EAIDTESRL

SEQ ID NO: 1727 - protein, 9 aa, Homo sapiens
IPEDILQLL

SEQ ID NO: 1728 - protein, 9 aa, Homo sapiens
SFCGKLRSL

SEQ ID NO: 1729 - protein, 9 aa, Homo sapiens
TLDCETARL

SEQ ID NO: 1730 - protein, 9 aa, Homo sapiens
TLKDDVNIL

SEQ ID NO: 1731 - protein, 9 aa, Homo sapiens
NILLDKARL

SEQ ID NO: 1732 - protein, 9 aa, Homo sapiens
DFIKATKVL

SEQ ID NO: 1733 - protein, 9 aa, Homo sapiens
EAINSDPEL

SEQ ID NO: 1734 - protein, 9 aa, Homo sapiens
ERYIVSQVL

SEQ ID NO: 1735 - protein, 9 aa, Homo sapiens
VTPPTKQSL

SEQ ID NO: 1736 - protein, 9 aa, Homo sapiens
VLKTPKCAL

SEQ ID NO: 1737 - protein, 9 aa, Homo sapiens
GISEYTMCL

SEQ ID NO: 1738 - protein, 9 aa, Homo sapiens
TNSPLVPTF

SEQ ID NO: 1739 - protein, 9 aa, Homo sapiens
PSTKNSIAL

SEQ ID NO: 1740 - protein, 9 aa, Homo sapiens
DLHSEVQTL

SEQ ID NO: 1741 - protein, 9 aa, Homo sapiens
LHSEVQTLK

SEQ ID NO: 1742 - protein, 9 aa, Homo sapiens
VHEQEAINS

SEQ ID NO: 1743 - protein, 9 aa, Homo sapiens
QKTDVKDDL

SEQ ID NO: 1744 - protein, 9 aa, Homo sapiens
DFECVTPKL

SEQ ID NO: 1745 - protein, 9 aa, Homo sapiens
EHFGISEYT

SEQ ID NO: 1746 - protein, 9 aa, Homo sapiens
LNEDYTMGL

SEQ ID NO: 1747 - protein, 9 aa, Homo sapiens
LEVEDRTSL

SEQ ID NO: 1748 - protein, 9 aa, Homo sapiens
VEDRTSLVL

SEQ ID NO: 1749 - protein, 9 aa, Homo sapiens
TISSYENLL

SEQ ID NO: 1750 - protein, 9 aa, Homo sapiens
KIPEDILQL

SEQ ID NO: 1751 - protein, 9 aa, Homo sapiens
LLSKYNSNL

SEQ ID NO: 1752 - protein, 9 aa, Homo sapiens
KLRSLASTL

SEQ ID NO: 1753 - protein, 9 aa, Homo sapiens
YPMRILYDL

SEQ ID NO: 1754 - protein, 9 aa, Homo sapiens
LKDDVNILL

SEQ ID NO: 1755 - protein, 9 aa, Homo sapiens
DAEYTNSPL

SEQ ID NO: 1756 - protein, 9 aa, Homo sapiens
VPTFCTPGL

SEQ ID NO: 1757 - protein, 9 aa, Homo sapiens
VTKIPEDIL

SEQ ID NO: 1758 - protein, 9 aa, Homo sapiens
KAVPPSKRF

SEQ ID NO: 1759 - protein, 9 aa, Homo sapiens
PIRSFCGKL

SEQ ID NO: 1760 - protein, 9 aa, Homo sapiens
SPQLSDFGL

SEQ ID NO: 1761 - protein, 9 aa, Homo sapiens
ESRLNDNVF

SEQ ID NO: 1762 - protein, 9 aa, Homo sapiens
ALVSTNYPL

SEQ ID NO: 1763 - protein, 9 aa, Homo sapiens
KTNSSSNDL

SEQ ID NO: 1764 - protein, 9 aa, Homo sapiens
NSDTCFENL

SEQ ID NO: 1765 - protein, 9 aa, Homo sapiens
PTISSYENL

SEQ ID NO: 1766 - protein, 9 aa, Homo sapiens
FIKATKVLM

SEQ ID NO: 1767 - protein, 9 aa, Homo sapiens
PRSPQLSDF

SEQ ID NO: 1768 - protein, 9 aa, Homo sapiens
DIMKIREYF

SEQ ID NO: 1769 - protein, 9 aa, Homo sapiens
KCALKMDDF

SEQ ID NO: 1770 - protein, 9 aa, Homo sapiens
CVTPKLEHF

SEQ ID NO: 1771 - protein, 9 aa, Homo sapiens
ALDGEESDF

SEQ ID NO: 1772 - protein, 9 aa, Homo sapiens
ESDFEDYPM

SEQ ID NO: 1773 - protein, 9 aa, Homo sapiens
LENQEGIDF

SEQ ID NO: 1774 - protein, 9 aa, Homo sapiens
KVLMEKNSM

SEQ ID NO: 1775 - protein, 9 aa, Homo sapiens
MEKNSMDIM

SEQ ID NO: 1776 - protein, 9 aa, Homo sapiens
PELSNCENF

SEQ ID NO: 1777 - protein, 9 aa, Homo sapiens
DLSDPPVAS

SEQ ID NO: 1778 - protein, 9 aa, Homo sapiens
ISEKSPRSP

SEQ ID NO: 1779 - protein, 9 aa, Homo sapiens
YKEEPVIVT

SEQ ID NO: 1780 - protein, 9 aa, Homo sapiens
KEEPVIVTP

SEQ ID NO: 1781 - protein, 9 aa, Homo sapiens
KTPKCALKM

SEQ ID NO: 1782 - protein, 9 aa, Homo sapiens
HFGISEYTM

SEQ ID NO: 1783 - protein, 9 aa, Homo sapiens
MCLNEDYTM

SEQ ID NO: 1784 - protein, 9 aa, Homo sapiens
TPTPPEVTK

SEQ ID NO: 1785 - protein, 9 aa, Homo sapiens
PRVKKNSVH

SEQ ID NO: 1786 - protein, 9 aa, Homo sapiens
ERYIVSQVL

SEQ ID NO: 1787 - protein, 9 aa, Homo sapiens
PRSPQLSDF

SEQ ID NO: 1788 - protein, 9 aa, Homo sapiens
ARLENQEGI

SEQ ID NO: 1789 - protein, 9 aa, Homo sapiens
IRSFCGKLR

SEQ ID NO: 1790 - protein, 9 aa, Homo sapiens
KATKVLMEK

SEQ ID NO: 1791 - protein, 9 aa, Homo sapiens
KIPEDILQL

SEQ ID NO: 1792 - protein, 9 aa, Homo sapiens
KAVPPSKRF

SEQ ID NO: 1793 - protein, 9 aa, Homo sapiens
KRFLKHGQN

SEQ ID NO: 1794 - protein, 9 aa, Homo sapiens
ARLQRALDG

SEQ ID NO: 1795 - protein, 9 aa, Homo sapiens
NILLDKARL

SEQ ID NO: 1796 - protein, 9 aa, Homo sapiens
GIDFIKATK

SEQ ID NO: 1797 - protein, 9 aa, Homo sapiens
ENFQKTDVK

SEQ ID NO: 1798 - protein, 9 aa, Homo sapiens
DDFECVTPK

SEQ ID NO: 1799 - protein, 9 aa, Homo sapiens
PGLKIPSTK

SEQ ID NO: 1800 - protein, 9 aa, Homo sapiens
DILQLLSKY

SEQ ID NO: 1801 - protein, 9 aa, Homo sapiens
KLRSLASTL

SEQ ID NO: 1802 - protein, 9 aa, Homo sapiens
LHSEVQTLK

SEQ ID NO: 1803 - protein, 9 aa, Homo sapiens
KVLMEKNSM

SEQ ID NO: 1804 - protein, 9 aa, Homo sapiens
REYFQKYGY

SEQ ID NO: 1805 - protein, 9 aa, Homo sapiens
YGYSPRVKK

SEQ ID NO: 1806 - protein, 9 aa, Homo sapiens
EAINSDPEL

SEQ ID NO: 1807 - protein, 9 aa, Homo sapiens
KQSLVKVLK

SEQ ID NO: 1808 - protein, 9 aa, Homo sapiens
KTPKCALKM

SEQ ID NO: 1809 - protein, 9 aa, Homo sapiens
GLKNARNNK

SEQ ID NO: 1810 - protein, 9 aa, Homo sapiens
TPSPIIQQL

SEQ ID NO: 1811 - protein, 9 aa, Homo sapiens
SPIIQQLEK

SEQ ID NO: 1812 - protein, 9 aa, Homo sapiens
LVLNSDTCF

SEQ ID NO: 1813 - protein, 9 aa, Homo sapiens
EDILQLLSK

SEQ ID NO: 1814 - protein, 9 aa, Homo sapiens
LLSKYNSNL

SEQ ID NO: 1815 - protein, 9 aa, Homo sapiens
RFLKHGQNI

SEQ ID NO: 1816 - protein, 9 aa, Homo sapiens
QNIRDVSNK

SEQ ID NO: 1817 - protein, 9 aa, Homo sapiens
SFCGKLRSL

SEQ ID NO: 1818 - protein, 9 aa, Homo sapiens
ALDGEESDF

SEQ ID NO: 1819 - protein, 9 aa, Homo sapiens
SDFEDYPMR

SEQ ID NO: 1820 - protein, 9 aa, Homo sapiens
MRILYDLHS

SEQ ID NO: 1821 - protein, 9 aa, Homo sapiens
VNILLDKAR

SEQ ID NO: 1822 - protein, 9 aa, Homo sapiens
DFIKATKVL

SEQ ID NO: 1823 - protein, 9 aa, Homo sapiens
MDIMKIREY

SEQ ID NO: 1824 - protein, 9 aa, Homo sapiens
VASSCISEK

SEQ ID NO: 1825 - protein, 9 aa, Homo sapiens
SCISEKSPR

SEQ ID NO: 1826 - protein, 9 aa, Homo sapiens
PPTKQSLVK

SEQ ID NO: 1827 - protein, 9 aa, Homo sapiens
LEHFGISEY

SEQ ID NO: 1828 - protein, 9 aa, Homo sapiens
GISEYTMCL

SEQ ID NO: 1829 - protein, 9 aa, Homo sapiens
YTMGLKNAR

SEQ ID NO: 1830 - protein, 9 aa, Homo sapiens
EAIDTESRL

SEQ ID NO: 1831 - protein, 9 aa, Homo sapiens
TNSPLVPTF

SEQ ID NO: 1832 - protein, 9 aa, Homo sapiens
SIALVSTNY

SEQ ID NO: 1833 - protein, 9 aa, Homo sapiens
KTNSSSNDL

SEQ ID NO: 1834 - protein, 9 aa, Homo sapiens
LEVEDRTSL

SEQ ID NO: 1835 - protein, 9 aa, Homo sapiens
DRTSLVLNS

SEQ ID NO: 1836 - protein, 9 aa, Homo sapiens
PTISSYENL

SEQ ID NO: 1837 - protein, 9 aa, Homo sapiens
NLATPIAIK

SEQ ID NO: 1838 - protein, 9 aa, Homo sapiens
IKAVPPSKR

SEQ ID NO: 1839 - protein, 9 aa, Homo sapiens
FLKHGQNIR

SEQ ID NO: 1840 - protein, 9 aa, Homo sapiens
LRSLASTLD

SEQ ID NO: 1841 - protein, 9 aa, Homo sapiens
STLDCETAR

SEQ ID NO: 1842 - protein, 9 aa, Homo sapiens
TLDCETARL

SEQ ID NO: 1843 - protein, 9 aa, Homo sapiens
QTLKDDVNI

SEQ ID NO: 1844 - protein, 9 aa, Homo sapiens
DDVNILLDK

SEQ ID NO: 1845 - protein, 9 aa, Homo sapiens
LENQEGIDF

SEQ ID NO: 1846 - protein, 9 aa, Homo sapiens
NQEGIDFIK

SEQ ID NO: 1847 - protein, 9 aa, Homo sapiens
KNSMDIMKI

SEQ ID NO: 1848 - protein, 9 aa, Homo sapiens
MKIREYFQK

SEQ ID NO: 1849 - protein, 9 aa, Homo sapiens
KYGYSPRVK

SEQ ID NO: 1850 - protein, 9 aa, Homo sapiens
PELSNCENF

SEQ ID NO: 1851 - protein, 9 aa, Homo sapiens
EKSPRSPQL

SEQ ID NO: 1852 - protein, 9 aa, Homo sapiens
NPPQAVNNY

SEQ ID NO: 1853 - protein, 9 aa, Homo sapiens
PVIVTPPTK

SEQ ID NO: 1854 - protein, 9 aa, Homo sapiens
LVKVLKTPK

SEQ ID NO: 1855 - protein, 9 aa, Homo sapiens
KCALKMDDF

SEQ ID NO: 1856 - protein, 9 aa, Homo sapiens
DFECVTPKL

SEQ ID NO: 1857 - protein, 9 aa, Homo sapiens
MCLNEDYTM

SEQ ID NO: 1858 - protein, 9 aa, Homo sapiens
ARNNKSEEA

SEQ ID NO: 1859 - protein, 9 aa, Homo sapiens
ESRLNDNVF

SEQ ID NO: 1860 - protein, 9 aa, Homo sapiens
SRLNDNVFA

SEQ ID NO: 1861 - protein, 9 aa, Homo sapiens
QLEKSDAEY

SEQ ID NO: 1862 - protein, 9 aa, Homo sapiens
PSTKNSIAL

SEQ ID NO: 1863 - protein, 9 aa, Homo sapiens
ALVSTNYPL

SEQ ID NO: 1864 - protein, 9 aa, Homo sapiens
PSSPTISSY

SEQ ID NO: 1865 - protein, 9 aa, Homo sapiens
ISSYENLLR

SEQ ID NO: 1866 - protein, 9 aa, Homo sapiens
TPTPPEVTK

SEQ ID NO: 1867 - protein, 9 aa, Homo sapiens
AIKAVPPSK

SEQ ID NO: 1868 - protein, 9 aa, Homo sapiens
AVPPSKRFL

SEQ ID NO: 1869 - protein, 9 aa, Homo sapiens
IRDVSNKEN

SEQ ID NO: 1870 - protein, 9 aa, Homo sapiens
DPIRSFCGK

SEQ ID NO: 1871 - protein, 9 aa, Homo sapiens
RSFCGKLRS

SEQ ID NO: 1872 - protein, 9 aa, Homo sapiens
ETARLQRAL

SEQ ID NO: 1873 - protein, 9 aa, Homo sapiens
YPMRILYDL

SEQ ID NO: 1874 - protein, 9 aa, Homo sapiens
DLHSEVQTL

SEQ ID NO: 1875 - protein, 9 aa, Homo sapiens
LKDDVNILL

SEQ ID NO: 1876 - protein, 9 aa, Homo sapiens
DIMKIREYF

SEQ ID NO: 1877 - protein, 9 aa, Homo sapiens
KIREYFQKY

SEQ ID NO: 1878 - protein, 9 aa, Homo sapiens
IREYFQKYG

SEQ ID NO: 1879 - protein, 9 aa, Homo sapiens
FQKYGYSPR

SEQ ID NO: 1880 - protein, 9 aa, Homo sapiens
LSNCENFQK

SEQ ID NO: 1881 - protein, 9 aa, Homo sapiens
SPQLSDFGL

SEQ ID NO: 1882 - protein, 9 aa, Homo sapiens
LSDFGLERY

SEQ ID NO: 1883 - protein, 9 aa, Homo sapiens
PPQAVNNYK

SEQ ID NO: 1884 - protein, 9 aa, Homo sapiens
NNYKEEPVI

SEQ ID NO: 1885 - protein, 9 aa, Homo sapiens
VTPPTKQSL

SEQ ID NO: 1886 - protein, 9 aa, Homo sapiens
TKQSLVKVL

SEQ ID NO: 1887 - protein, 9 aa, Homo sapiens
LKTPKCALK

SEQ ID NO: 1888 - protein, 9 aa, Homo sapiens
ECVTPKLEH

SEQ ID NO: 1889 - protein, 9 aa, Homo sapiens
CVTPKLEHF

SEQ ID NO: 1890 - protein, 9 aa, Homo sapiens
RNNKSEEAI

SEQ ID NO: 1891 - protein, 9 aa, Homo sapiens
PTFCTPGLK

SEQ ID NO: 1892 - protein, 9 aa, Homo sapiens
SNDLEVEDR

SEQ ID NO: 1893 - protein, 9 aa, Homo sapiens
VEDRTSLVL

SEQ ID NO: 1894 - protein, 9 aa, Homo sapiens
LRTPTPPEV

SEQ ID NO: 1895 - protein, 9 aa, Homo sapiens
PTPPEVTKI

SEQ ID NO: 1896 - protein, 9 aa, Homo sapiens
IPEDILQLL

SEQ ID NO: 1897 - protein, 9 aa, Homo sapiens
PPSKRFLKH

SEQ ID NO: 1898 - protein, 9 aa, Homo sapiens
PIRSFCGKL

SEQ ID NO: 1899 - protein, 9 aa, Homo sapiens
DCETARLQR

SEQ ID NO: 1900 - protein, 9 aa, Homo sapiens
QRALDGEES

SEQ ID NO: 1901 - protein, 9 aa, Homo sapiens
EDYPMRILY

SEQ ID NO: 1902 - protein, 9 aa, Homo sapiens
TLKDDVNIL

SEQ ID NO: 1903 - protein, 9 aa, Homo sapiens
ENQEGIDFI

SEQ ID NO: 1904 - protein, 9 aa, Homo sapiens
EKNSMDIMK

SEQ ID NO: 1905 - protein, 9 aa, Homo sapiens
QKTDVKDDL

SEQ ID NO: 1906 - protein, 9 aa, Homo sapiens
QLSDFGLER

SEQ ID NO: 1907 - protein, 9 aa, Homo sapiens
SDFGLERYI

SEQ ID NO: 1908 - protein, 9 aa, Homo sapiens
VLKTPKCAL

SEQ ID NO: 1909 - protein, 9 aa, Homo sapiens
DAEYTNSPL

SEQ ID NO: 1910 - protein, 9 aa, Homo sapiens
VSTNYPLSK

SEQ ID NO: 1911 - protein, 9 aa, Homo sapiens
NSDTCFENL

SEQ ID NO: 1912 - protein, 9 aa, Homo sapiens
ERYIVSQVL

SEQ ID NO: 1913 - protein, 9 aa, Homo sapiens
ARLENQEGI

SEQ ID NO: 1914 - protein, 9 aa, Homo sapiens
LRTPTPPEV

SEQ ID NO: 1915 - protein, 9 aa, Homo sapiens
PRSPQLSDF

SEQ ID NO: 1916 - protein, 9 aa, Homo sapiens
ARLQRALDG

SEQ ID NO: 1917 - protein, 9 aa, Homo sapiens
DRTSLVLNS

SEQ ID NO: 1918 - protein, 9 aa, Homo sapiens
KIPEDILQL

SEQ ID NO: 1919 - protein, 9 aa, Homo sapiens
KRFLKHGQN

SEQ ID NO: 1920 - protein, 9 aa, Homo sapiens
RFLKHGQNI

SEQ ID NO: 1921 - protein, 9 aa, Homo sapiens
KLRSLASTL

SEQ ID NO: 1922 - protein, 9 aa, Homo sapiens
NILLDKARL

SEQ ID NO: 1923 - protein, 9 aa, Homo sapiens
SRLNDNVFA

SEQ ID NO: 1924 - protein, 9 aa, Homo sapiens
ALVSTNYPL

SEQ ID NO: 1925 - protein, 9 aa, Homo sapiens
QTLKDDVNI

SEQ ID NO: 1926 - protein, 9 aa, Homo sapiens
EKSPRSPQL

SEQ ID NO: 1927 - protein, 9 aa, Homo sapiens
GISEYTMCL

SEQ ID NO: 1928 - protein, 9 aa, Homo sapiens
TPSPIIQQL

SEQ ID NO: 1929 - protein, 9 aa, Homo sapiens
KTNSSSNDL

SEQ ID NO: 1930 - protein, 9 aa, Homo sapiens
PTISSYENL

SEQ ID NO: 1931 - protein, 9 aa, Homo sapiens
KAVPPSKRF

SEQ ID NO: 1932 - protein, 9 aa, Homo sapiens
YPMRILYDL

SEQ ID NO: 1933 - protein, 9 aa, Homo sapiens
MRILYDLHS

SEQ ID NO: 1934 - protein, 9 aa, Homo sapiens
DLHSEVQTL

SEQ ID NO: 1935 - protein, 9 aa, Homo sapiens
TLKDDVNIL

SEQ ID NO: 1936 - protein, 9 aa, Homo sapiens
IDFIKATKV

SEQ ID NO: 1937 - protein, 9 aa, Homo sapiens
KVLMEKNSM

SEQ ID NO: 1938 - protein, 9 aa, Homo sapiens
QKYGYSPRV

SEQ ID NO: 1939 - protein, 9 aa, Homo sapiens
EAINSDPEL

SEQ ID NO: 1940 - protein, 9 aa, Homo sapiens
PELSNCENF

SEQ ID NO: 1941 - protein, 9 aa, Homo sapiens
TKQSLVKVL

SEQ ID NO: 1942 - protein, 9 aa, Homo sapiens
KTPKCALKM

SEQ ID NO: 1943 - protein, 9 aa, Homo sapiens
RNNKSEEAI

SEQ ID NO: 1944 - protein, 9 aa, Homo sapiens
EAIDTESRL

SEQ ID NO: 1945 - protein, 9 aa, Homo sapiens
AEYTNSPLV

SEQ ID NO: 1946 - protein, 9 aa, Homo sapiens
VPTFCTPGL

SEQ ID NO: 1947 - protein, 9 aa, Homo sapiens
LEVEDRTSL

SEQ ID NO: 1948 - protein, 9 aa, Homo sapiens
IPEDILQLL

SEQ ID NO: 1949 - protein, 9 aa, Homo sapiens
AVPPSKRFL

SEQ ID NO: 1950 - protein, 9 aa, Homo sapiens
PIRSFCGKL

SEQ ID NO: 1951 - protein, 9 aa, Homo sapiens
IRSFCGKLR

SEQ ID NO: 1952 - protein, 9 aa, Homo sapiens
TLDCETARL

SEQ ID NO: 1953 - protein, 9 aa, Homo sapiens
QRALDGEES

SEQ ID NO: 1954 - protein, 9 aa, Homo sapiens
ILYDLHSEV

SEQ ID NO: 1955 - protein, 9 aa, Homo sapiens
DFIKATKVL

SEQ ID NO: 1956 - protein, 9 aa, Homo sapiens
KNSMDIMKI

SEQ ID NO: 1957 - protein, 9 aa, Homo sapiens
IREYFQKYG

SEQ ID NO: 1958 - protein, 9 aa, Homo sapiens
PRVKKNSVH

SEQ ID NO: 1959 - protein, 9 aa, Homo sapiens
QKTDVKDDL

SEQ ID NO: 1960 - protein, 9 aa, Homo sapiens
KDDLSDPPV

SEQ ID NO: 1961 - protein, 9 aa, Homo sapiens
LERYIVSQV

SEQ ID NO: 1962 - protein, 9 aa, Homo sapiens
NNYKEEPVI

SEQ ID NO: 1963 - protein, 9 aa, Homo sapiens
VTPPTKQSL

SEQ ID NO: 1964 - protein, 9 aa, Homo sapiens
DFECVTPKL

SEQ ID NO: 1965 - protein, 9 aa, Homo sapiens
MCLNEDYTM

SEQ ID NO: 1966 - protein, 9 aa, Homo sapiens
ARNNKSEEA

SEQ ID NO: 1967 - protein, 9 aa, Homo sapiens
TNSPLVPTF

SEQ ID NO: 1968 - protein, 9 aa, Homo sapiens
KIPSTKNSI

SEQ ID NO: 1969 - protein, 9 aa, Homo sapiens
PSTKNSIAL

SEQ ID NO: 1970 - protein, 9 aa, Homo sapiens
VEDRTSLVL

SEQ ID NO: 1971 - protein, 9 aa, Homo sapiens
NSDTCFENL

SEQ ID NO: 1972 - protein, 9 aa, Homo sapiens
TISSYENLL

SEQ ID NO: 1973 - protein, 9 aa, Homo sapiens
DPPVASSCI

SEQ ID NO: 1974 - protein, 9 aa, Homo sapiens
TPPTKQSLV

SEQ ID NO: 1975 - protein, 9 aa, Homo sapiens
DAEYTNSPL

SEQ ID NO: 1976 - protein, 9 aa, Homo sapiens
TPKLEHFGI

SEQ ID NO: 1977 - protein, 9 aa, Homo sapiens
SPRVKKNSV

SEQ ID NO: 1978 - protein, 9 aa, Homo sapiens
IPEDILQLL

SEQ ID NO: 1979 - protein, 9 aa, Homo sapiens
YPMRILYDL

SEQ ID NO: 1980 - protein, 9 aa, Homo sapiens
NNYKEEPVI

SEQ ID NO: 1981 - protein, 9 aa, Homo sapiens
EAIDTESRL

SEQ ID NO: 1982 - protein, 9 aa, Homo sapiens
DFEDYPMRI

SEQ ID NO: 1983 - protein, 9 aa, Homo sapiens
TPSPIIQQL

SEQ ID NO: 1984 - protein, 9 aa, Homo sapiens
EAINSDPEL

SEQ ID NO: 1985 - protein, 9 aa, Homo sapiens
SPQLSDFGL

SEQ ID NO: 1986 - protein, 9 aa, Homo sapiens
VPTFCTPGL

SEQ ID NO: 1987 - protein, 9 aa, Homo sapiens
TPPEVTKIP

SEQ ID NO: 1988 - protein, 9 aa, Homo sapiens
DPIRSFCGK

SEQ ID NO: 1989 - protein, 9 aa, Homo sapiens
IDFIKATKV

SEQ ID NO: 1990 - protein, 9 aa, Homo sapiens
DPELSNCEN

SEQ ID NO: 1991 - protein, 9 aa, Homo sapiens
IALVSTNYP

SEQ ID NO: 1992 - protein, 9 aa, Homo sapiens
YPLSKTNSS

SEQ ID NO: 1993 - protein, 9 aa, Homo sapiens
PTPPEVTKI

SEQ ID NO: 1994 - protein, 9 aa, Homo sapiens
SNLATPIAI

SEQ ID NO: 1995 - protein, 9 aa, Homo sapiens
LATPIAIKA

SEQ ID NO: 1996 - protein, 9 aa, Homo sapiens
ILYDLHSEV

SEQ ID NO: 1997 - protein, 9 aa, Homo sapiens
DFIKATKVL

SEQ ID NO: 1998 - protein, 9 aa, Homo sapiens
QKYGYSPRV

SEQ ID NO: 1999 - protein, 9 aa, Homo sapiens
YGYSPRVKK

SEQ ID NO: 2000 - protein, 9 aa, Homo sapiens
FGLERYIVS

SEQ ID NO: 2001 - protein, 9 aa, Homo sapiens
ERYIVSQVL

SEQ ID NO: 2002 - protein, 9 aa, Homo sapiens
LPNPPQAVN

SEQ ID NO: 2003 - protein, 9 aa, Homo sapiens
NPPQAVNNY

SEQ ID NO: 2004 - protein, 9 aa, Homo sapiens
PPQAVNNYK

SEQ ID NO: 2005 - protein, 9 aa, Homo sapiens
PPTKQSLVK

SEQ ID NO: 2006 - protein, 9 aa, Homo sapiens
NVFATPSPI

SEQ ID NO: 2007 - protein, 9 aa, Homo sapiens
TFCTPGLKI

SEQ ID NO: 2008 - protein, 9 aa, Homo sapiens
IPSTKNSIA

SEQ ID NO: 2009 - protein, 9 aa, Homo sapiens
LTDPSSPTI

SEQ ID NO: 2010 - protein, 9 aa, Homo sapiens
DPSSPTISS

SEQ ID NO: 2011 - protein, 9 aa, Homo sapiens
TPIAIKAVP

SEQ ID NO: 2012 - protein, 9 aa, Homo sapiens
IAIKAVPPS

SEQ ID NO: 2013 - protein, 9 aa, Homo sapiens
PPSKRFLKH

SEQ ID NO: 2014 - protein, 9 aa, Homo sapiens
DLHSEVQTL

SEQ ID NO: 2015 - protein, 9 aa, Homo sapiens
QTLKDDVNI

SEQ ID NO: 2016 - protein, 9 aa, Homo sapiens
ARLENQEGI

SEQ ID NO: 2017 - protein, 9 aa, Homo sapiens
KATKVLMEK

SEQ ID NO: 2018 - protein, 9 aa, Homo sapiens
CALKMDDFE

SEQ ID NO: 2019 - protein, 9 aa, Homo sapiens
DFECVTPKL

SEQ ID NO: 2020 - protein, 9 aa, Homo sapiens
FATPSPIIQ

SEQ ID NO: 2021 - protein, 9 aa, Homo sapiens
TPTPPEVTK

SEQ ID NO: 2022 - protein, 9 aa, Homo sapiens
YNSNLATPI

SEQ ID NO: 2023 - protein, 9 aa, Homo sapiens
LASTLDCET

SEQ ID NO: 2024 - protein, 9 aa, Homo sapiens
RALDGEESD

SEQ ID NO: 2025 - protein, 9 aa, Homo sapiens
DGEESDFED

SEQ ID NO: 2026 - protein, 9 aa, Homo sapiens
LKDDVNILL

SEQ ID NO: 2027 - protein, 9 aa, Homo sapiens
ENQEGIDFI

SEQ ID NO: 2028 - protein, 9 aa, Homo sapiens
LMEKNSMDI

SEQ ID NO: 2029 - protein, 9 aa, Homo sapiens
KNSMDIMKI

SEQ ID NO: 2030 - protein, 9 aa, Homo sapiens
SDFGLERYI

SEQ ID NO: 2031 - protein, 9 aa, Homo sapiens
NYKEEPVIV

SEQ ID NO: 2032 - protein, 9 aa, Homo sapiens
PTKQSLVKV

SEQ ID NO: 2033 - protein, 9 aa, Homo sapiens
TKQSLVKVL

SEQ ID NO: 2034 - protein, 9 aa, Homo sapiens
TPKCALKMD

SEQ ID NO: 2035 - protein, 9 aa, Homo sapiens
AEYTNSPLV

SEQ ID NO: 2036 - protein, 9 aa, Homo sapiens
TPGLKIPST

SEQ ID NO: 2037 - protein, 9 aa, Homo sapiens
KIPSTKNSI

SEQ ID NO: 2038 - protein, 9 aa, Homo sapiens
VPPSKRFLK

SEQ ID NO: 2039 - protein, 9 aa, Homo sapiens
RFLKHGQNI

SEQ ID NO: 2040 - protein, 9 aa, Homo sapiens
PPVASSCIS

SEQ ID NO: 2041 - protein, 9 aa, Homo sapiens
VASSCISEK

SEQ ID NO: 2042 - protein, 9 aa, Homo sapiens
DFGLERYIV

SEQ ID NO: 2043 - protein, 9 aa, Homo sapiens
LERYIVSQV

SEQ ID NO: 2044 - protein, 9 aa, Homo sapiens
EPVIVTPPT

SEQ ID NO: 2045 - protein, 9 aa, Homo sapiens
LKMDDFECV

SEQ ID NO: 2046 - protein, 9 aa, Homo sapiens
MGLKNARNN

SEQ ID NO: 2047 - protein, 9 aa, Homo sapiens
RNNKSEEAI

SEQ ID NO: 2048 - protein, 9 aa, Homo sapiens
VFATPSPII

SEQ ID NO: 2049 - protein, 9 aa, Homo sapiens
SPLVPTFCT

SEQ ID NO: 2050 - protein, 9 aa, Homo sapiens
PGLKIPSTK

SEQ ID NO: 2051 - protein, 9 aa, Homo sapiens
VEDRTSLVL

SEQ ID NO: 2052 - protein, 9 aa, Homo sapiens
LRTPTPPEV

SEQ ID NO: 2053 - protein, 9 aa, Homo sapiens
PPEVTKIPE

SEQ ID NO: 2054 - protein, 9 aa, Homo sapiens
EVTKIPEDI

SEQ ID NO: 2055 - protein, 9 aa, Homo sapiens
KAVPPSKRF

SEQ ID NO: 2056 - protein, 10 aa, Homo sapiens
LLRTPTPPEV

SEQ ID NO: 2057 - protein, 10 aa, Homo sapiens
KIPEDILQLL

SEQ ID NO: 2058 - protein, 10 aa, Homo sapiens
GLERYIVSQV

SEQ ID NO: 2059 - protein, 10 aa, Homo sapiens
CLNEDYTMGL

SEQ ID NO: 2060 - protein, 10 aa, Homo sapiens
VLMEKNSMDI

SEQ ID NO: 2061 - protein, 10 aa, Homo sapiens
QLLSKYNSNL

SEQ ID NO: 2062 - protein, 10 aa, Homo sapiens
STLDCETARL

SEQ ID NO: 2063 - protein, 10 aa, Homo sapiens
RILYDLHSEV

SEQ ID NO: 2064 - protein, 10 aa, Homo sapiens
QTLKDDVNIL

SEQ ID NO: 2065 - protein, 10 aa, Homo sapiens
ALKMDDFECV

SEQ ID NO: 2066 - protein, 10 aa, Homo sapiens
NLTDPSSPTI

SEQ ID NO: 2067 - protein, 10 aa, Homo sapiens
LATPIAIKAV

SEQ ID NO: 2068 - protein, 10 aa, Homo sapiens
SLASTLDCET

SEQ ID NO: 2069 - protein, 10 aa, Homo sapiens
YDLHSEVQTL

SEQ ID NO: 2070 - protein, 10 aa, Homo sapiens
TLKDDVNILL

SEQ ID NO: 2071 - protein, 10 aa, Homo sapiens
GIDFIKATKV

SEQ ID NO: 2072 - protein, 10 aa, Homo sapiens
ATPSPIIQQL

SEQ ID NO: 2073 - protein, 10 aa, Homo sapiens
DLEVEDRTSL

SEQ ID NO: 2074 - protein, 10 aa, Homo sapiens
QVLPNPPQAV

SEQ ID NO: 2075 - protein, 10 aa, Homo sapiens
IVTPPTKQSL

SEQ ID NO: 2076 - protein, 10 aa, Homo sapiens
IALVSTNYPL

SEQ ID NO: 2077 - protein, 10 aa, Homo sapiens
TKIPEDILQL

SEQ ID NO: 2078 - protein, 10 aa, Homo sapiens
ILLDKARLEN

SEQ ID NO: 2079 - protein, 10 aa, Homo sapiens
DLSDPPVASS

SEQ ID NO: 2080 - protein, 10 aa, Homo sapiens
KVLKTPKCAL

SEQ ID NO: 2081 - protein, 10 aa, Homo sapiens
LVPTFCTPGL

SEQ ID NO: 2082 - protein, 10 aa, Homo sapiens
NLATPIAIKA

SEQ ID NO: 2083 - protein, 10 aa, Homo sapiens
LKHGQNIRDV

SEQ ID NO: 2084 - protein, 10 aa, Homo sapiens
RSFCGKLRSL

SEQ ID NO: 2085 - protein, 10 aa, Homo sapiens
AVNNYKEEPV

SEQ ID NO: 2086 - protein, 10 aa, Homo sapiens
VTPPTKQSLV

SEQ ID NO: 2087 - protein, 10 aa, Homo sapiens
CTPGLKIPST

SEQ ID NO: 2088 - protein, 10 aa, Homo sapiens
LKIPSTKNSI

SEQ ID NO: 2089 - protein, 10 aa, Homo sapiens
LLSKYNSNLA

SEQ ID NO: 2090 - protein, 10 aa, Homo sapiens
KAVPPSKRFL

SEQ ID NO: 2091 - protein, 10 aa, Homo sapiens
LLDKARLENQ

SEQ ID NO: 2092 - protein, 10 aa, Homo sapiens
SMDIMKIREY

SEQ ID NO: 2093 - protein, 10 aa, Homo sapiens
SDFGLERYIV

SEQ ID NO: 2094 - protein, 10 aa, Homo sapiens
KLEHFGISEY

SEQ ID NO: 2095 - protein, 10 aa, Homo sapiens
RLNDNVFATP

SEQ ID NO: 2096 - protein, 10 aa, Homo sapiens
SDAEYTNSPL

SEQ ID NO: 2097 - protein, 10 aa, Homo sapiens
GKLRSLASTL

SEQ ID NO: 2098 - protein, 10 aa, Homo sapiens
VNILLDKARL

SEQ ID NO: 2099 - protein, 10 aa, Homo sapiens
LENQEGIDFI

SEQ ID NO: 2100 - protein, 10 aa, Homo sapiens
YSPRVKKNSV

SEQ ID NO: 2101 - protein, 10 aa, Homo sapiens
QEAINSDPEL

SEQ ID NO: 2102 - protein, 10 aa, Homo sapiens
QLSDFGLERY

SEQ ID NO: 2103 - protein, 10 aa, Homo sapiens
YIVSQVLPNP

SEQ ID NO: 2104 - protein, 10 aa, Homo sapiens
DDFECVTPKL

SEQ ID NO: 2105 - protein, 10 aa, Homo sapiens
TMCLNEDYTM

SEQ ID NO: 2106 - protein, 10 aa, Homo sapiens
TPTPPEVTKI

SEQ ID NO: 2107 - protein, 10 aa, Homo sapiens
ALDGEESDFE

SEQ ID NO: 2108 - protein, 10 aa, Homo sapiens
DYPMRILYDL

SEQ ID NO: 2109 - protein, 10 aa, Homo sapiens
ILYDLHSEVQ

SEQ ID NO: 2110 - protein, 10 aa, Homo sapiens
KARLENQEGI

SEQ ID NO: 2111 - protein, 10 aa, Homo sapiens
AINSDPELSN

SEQ ID NO: 2112 - protein, 10 aa, Homo sapiens
PPTKQSLVKV

SEQ ID NO: 2113 - protein, 10 aa, Homo sapiens
KMDDFECVTP

SEQ ID NO: 2114 - protein, 10 aa, Homo sapiens
VTPKLEHFGI

SEQ ID NO: 2115 - protein, 10 aa, Homo sapiens
NVFATPSPII

SEQ ID NO: 2116 - protein, 10 aa, Homo sapiens
IIQQLEKSDA

SEQ ID NO: 2117 - protein, 10 aa, Homo sapiens
YTNSPLVPTF

SEQ ID NO: 2118 - protein, 10 aa, Homo sapiens
LEVEDRTSLV

SEQ ID NO: 2119 - protein, 10 aa, Homo sapiens
VLNSDTCFEN

SEQ ID NO: 2120 - protein, 10 aa, Homo sapiens
PTISSYENLL

SEQ ID NO: 2121 - protein, 10 aa, Homo sapiens
DPIRSFCGKL

SEQ ID NO: 2122 - protein, 10 aa, Homo sapiens
SDFEDYPMRI

SEQ ID NO: 2123 - protein, 10 aa, Homo sapiens
FIKATKVLME

SEQ ID NO: 2124 - protein, 10 aa, Homo sapiens
LMEKNSMDIM

SEQ ID NO: 2125 - protein, 10 aa, Homo sapiens
VKDDLSDPPV

SEQ ID NO: 2126 - protein, 10 aa, Homo sapiens
FGLERYIVSQ

SEQ ID NO: 2127 - protein, 10 aa, Homo sapiens
VLPNPPQAVN

SEQ ID NO: 2128 - protein, 10 aa, Homo sapiens
NNYKEEPVIV

SEQ ID NO: 2129 - protein, 10 aa, Homo sapiens
PTKQSLVKVL

SEQ ID NO: 2130 - protein, 10 aa, Homo sapiens
FGISEYTMCL

SEQ ID NO: 2131 - protein, 10 aa, Homo sapiens
GLKNARNNKS

SEQ ID NO: 2132 - protein, 10 aa, Homo sapiens
SRLNDNVFAT

SEQ ID NO: 2133 - protein, 10 aa, Homo sapiens
QLEKSDAEYT

SEQ ID NO: 2134 - protein, 10 aa, Homo sapiens
PTFCTPGLKI

SEQ ID NO: 2135 - protein, 10 aa, Homo sapiens
KIPSTKNSIA

SEQ ID NO: 2136 - protein, 10 aa, Homo sapiens
IPSTKNSIAL

SEQ ID NO: 2137 - protein, 10 aa, Homo sapiens
TKNSIALVST

SEQ ID NO: 2138 - protein, 10 aa, Homo sapiens
SIALVSTNYP

SEQ ID NO: 2139 - protein, 10 aa, Homo sapiens
ALVSTNYPLS

SEQ ID NO: 2140 - protein, 10 aa, Homo sapiens
TNSSSNDLEV

SEQ ID NO: 2141 - protein, 10 aa, Homo sapiens
LNSDTCFENL

SEQ ID NO: 2142 - protein, 10 aa, Homo sapiens
NLLRTPTPPE

SEQ ID NO: 2143 - protein, 10 aa, Homo sapiens
ILQLLSKYNS

SEQ ID NO: 2144 - protein, 10 aa, Homo sapiens
LASTLDCETA

SEQ ID NO: 2145 - protein, 10 aa, Homo sapiens
RLQRALDGEE

SEQ ID NO: 2146 - protein, 10 aa, Homo sapiens
SEVQTLKDDV

SEQ ID NO: 2147 - protein, 10 aa, Homo sapiens
IDFIKATKVL

SEQ ID NO: 2148 - protein, 10 aa, Homo sapiens
EKNSMDIMKI

SEQ ID NO: 2149 - protein, 10 aa, Homo sapiens
SDPPVASSCI

SEQ ID NO: 2150 - protein, 10 aa, Homo sapiens
CISEKSPRSP

SEQ ID NO: 2151 - protein, 10 aa, Homo sapiens
SEKSPRSPQL

SEQ ID NO: 2152 - protein, 10 aa, Homo sapiens
KQSLVKVLKT

SEQ ID NO: 2153 - protein, 10 aa, Homo sapiens
SLVKVLKTPK

SEQ ID NO: 2154 - protein, 10 aa, Homo sapiens
VLKTPKCALK

SEQ ID NO: 2155 - protein, 10 aa, Homo sapiens
ARNNKSEEAI

SEQ ID NO: 2156 - protein, 10 aa, Homo sapiens
DTESRLNDNV

SEQ ID NO: 2157 - protein, 10 aa, Homo sapiens
DAEYTNSPLV

SEQ ID NO: 2158 - protein, 10 aa, Homo sapiens
PSTKNSIALV

SEQ ID NO: 2159 - protein, 10 aa, Homo sapiens
SKTNSSSNDL

SEQ ID NO: 2160 - protein, 10 aa, Homo sapiens
EVEDRTSLVL

SEQ ID NO: 2161 - protein, 10 aa, Homo sapiens
SLVLNSDTCF

SEQ ID NO: 2162 - protein, 10 aa, Homo sapiens
PIAIKAVPPS

SEQ ID NO: 2163 - protein, 10 aa, Homo sapiens
SFCGKLRSLA

SEQ ID NO: 2164 - protein, 10 aa, Homo sapiens
LASTLDCETA

SEQ ID NO: 2165 - protein, 10 aa, Homo sapiens
DCETARLQRA

SEQ ID NO: 2166 - protein, 10 aa, Homo sapiens
DDVNILLDKA

SEQ ID NO: 2167 - protein, 10 aa, Homo sapiens
NQEGIDFIKA

SEQ ID NO: 2168 - protein, 10 aa, Homo sapiens
KKNSVHEQEA

SEQ ID NO: 2169 - protein, 10 aa, Homo sapiens
KDDLSDPPVA

SEQ ID NO: 2170 - protein, 10 aa, Homo sapiens
SQVLPNPPQA

SEQ ID NO: 2171 - protein, 10 aa, Homo sapiens
VKVLKTPKCA

SEQ ID NO: 2172 - protein, 10 aa, Homo sapiens
EDYTMGLKNA

SEQ ID NO: 2173 - protein, 10 aa, Homo sapiens
NARNNKSEEA

SEQ ID NO: 2174 - protein, 10 aa, Homo sapiens
ESRLNDNVFA

SEQ ID NO: 2175 - protein, 10 aa, Homo sapiens
IIQQLEKSDA

SEQ ID NO: 2176 - protein, 10 aa, Homo sapiens
KIPSTKNSIA

SEQ ID NO: 2177 - protein, 10 aa, Homo sapiens
LLSKYNSNLA

SEQ ID NO: 2178 - protein, 10 aa, Homo sapiens
YNSNLATPIA

SEQ ID NO: 2179 - protein, 10 aa, Homo sapiens
NLATPIAIKA

SEQ ID NO: 2180 - protein, 10 aa, Homo sapiens
FCGKLRSLAS

SEQ ID NO: 2181 - protein, 10 aa, Homo sapiens
ASTLDCETAR

SEQ ID NO: 2182 - protein, 10 aa, Homo sapiens
CETARLQRAL

SEQ ID NO: 2183 - protein, 10 aa, Homo sapiens
DVNILLDKAR

SEQ ID NO: 2184 - protein, 10 aa, Homo sapiens
QEGIDFIKAT

SEQ ID NO: 2185 - protein, 10 aa, Homo sapiens
KNSVHEQEAI

SEQ ID NO: 2186 - protein, 10 aa, Homo sapiens
DDLSDPPVAS

SEQ ID NO: 2187 - protein, 10 aa, Homo sapiens
QVLPNPPQAV

SEQ ID NO: 2188 - protein, 10 aa, Homo sapiens
KVLKTPKCAL

SEQ ID NO: 2189 - protein, 10 aa, Homo sapiens
DYTMGLKNAR

SEQ ID NO: 2190 - protein, 10 aa, Homo sapiens
ARNNKSEEAI

SEQ ID NO: 2191 - protein, 10 aa, Homo sapiens
SRLNDNVFAT

SEQ ID NO: 2192 - protein, 10 aa, Homo sapiens
IQQLEKSDAE

SEQ ID NO: 2193 - protein, 10 aa, Homo sapiens
IPSTKNSIAL

SEQ ID NO: 2194 - protein, 10 aa, Homo sapiens
LSKYNSNLAT

SEQ ID NO: 2195 - protein, 10 aa, Homo sapiens
NSNLATPIAI

SEQ ID NO: 2196 - protein, 10 aa, Homo sapiens
LATPIAIKAV

SEQ ID NO: 2197 - protein, 10 aa, Homo sapiens
CGKLRSLAST

SEQ ID NO: 2198 - protein, 10 aa, Homo sapiens
STLDCETARL

SEQ ID NO: 2199 - protein, 10 aa, Homo sapiens
ETARLQRALD

SEQ ID NO: 2200 - protein, 10 aa, Homo sapiens
VNILLDKARL

SEQ ID NO: 2201 - protein, 10 aa, Homo sapiens
EGIDFIKATK

SEQ ID NO: 2202 - protein, 10 aa, Homo sapiens
NSVHEQEAIN

SEQ ID NO: 2203 - protein, 10 aa, Homo sapiens
DLSDPPVASS

SEQ ID NO: 2204 - protein, 10 aa, Homo sapiens
VLPNPPQAVN

SEQ ID NO: 2205 - protein, 10 aa, Homo sapiens
VLKTPKCALK

SEQ ID NO: 2206 - protein, 10 aa, Homo sapiens
YTMGLKNARN

SEQ ID NO: 2207 - protein, 10 aa, Homo sapiens
RNNKSEEAID

SEQ ID NO: 2208 - protein, 10 aa, Homo sapiens
RLNDNVFATP

SEQ ID NO: 2209 - protein, 10 aa, Homo sapiens
QQLEKSDAEY

SEQ ID NO: 2210 - protein, 10 aa, Homo sapiens
PSTKNSIALV

SEQ ID NO: 2211 - protein, 10 aa, Homo sapiens
SKYNSNLATP

SEQ ID NO: 2212 - protein, 10 aa, Homo sapiens
SNLATPIAIK

SEQ ID NO: 2213 - protein, 10 aa, Homo sapiens
ATPIAIKAVP

SEQ ID NO: 2214 - protein, 10 aa, Homo sapiens
FEDYPMRILY

SEQ ID NO: 2215 - protein, 10 aa, Homo sapiens
DGEESDFEDY

SEQ ID NO: 2216 - protein, 10 aa, Homo sapiens
SMDIMKIREY

SEQ ID NO: 2217 - protein, 10 aa, Homo sapiens
KLEHFGISEY

SEQ ID NO: 2218 - protein, 10 aa, Homo sapiens
IREYFQKYGY

SEQ ID NO: 2219 - protein, 10 aa, Homo sapiens
KTDVKDDLSD

SEQ ID NO: 2220 - protein, 10 aa, Homo sapiens
NQEGIDFIKA

SEQ ID NO: 2221 - protein, 10 aa, Homo sapiens
MKIREYFQKY

SEQ ID NO: 2222 - protein, 10 aa, Homo sapiens
PNPPQAVNNY

SEQ ID NO: 2223 - protein, 10 aa, Homo sapiens
ISEYTMCLNE

SEQ ID NO: 2224 - protein, 10 aa, Homo sapiens
LTDPSSPTIS

SEQ ID NO: 2225 - protein, 10 aa, Homo sapiens
NEDYTMGLKN

SEQ ID NO: 2226 - protein, 10 aa, Homo sapiens
NSIALVSTNY

SEQ ID NO: 2227 - protein, 10 aa, Homo sapiens
LKDDVNILLD

SEQ ID NO: 2228 - protein, 10 aa, Homo sapiens
NSDPELSNCE

SEQ ID NO: 2229 - protein, 10 aa, Homo sapiens
LSDPPVASSC

SEQ ID NO: 2230 - protein, 10 aa, Homo sapiens
AIDTESRLND

SEQ ID NO: 2231 - protein, 10 aa, Homo sapiens
IPEDILQLLS

SEQ ID NO: 2232 - protein, 10 aa, Homo sapiens
DTESRLNDNV

SEQ ID NO: 2233 - protein, 10 aa, Homo sapiens
EVEDRTSLVL

SEQ ID NO: 2234 - protein, 10 aa, Homo sapiens
EDILQLLSKY

SEQ ID NO: 2235 - protein, 10 aa, Homo sapiens
KDDVNILLDK

SEQ ID NO: 2236 - protein, 10 aa, Homo sapiens
RLENQEGIDF

SEQ ID NO: 2237 - protein, 10 aa, Homo sapiens
QLSDFGLERY

SEQ ID NO: 2238 - protein, 10 aa, Homo sapiens
EYTMCLNEDY

SEQ ID NO: 2239 - protein, 10 aa, Homo sapiens
NSDTCFENLT

SEQ ID NO: 2240 - protein, 10 aa, Homo sapiens
PEDILQLLSK

SEQ ID NO: 2241 - protein, 10 aa, Homo sapiens
ATPSPIIQQL

SEQ ID NO: 2242 - protein, 10 aa, Homo sapiens
YTNSPLVPTF

SEQ ID NO: 2243 - protein, 10 aa, Homo sapiens
KIPEDILQLL

SEQ ID NO: 2244 - protein, 10 aa, Homo sapiens
DFEDYPMRIL

SEQ ID NO: 2245 - protein, 10 aa, Homo sapiens
EVEDRTSLVL

SEQ ID NO: 2246 - protein, 10 aa, Homo sapiens
EVTKIPEDIL

SEQ ID NO: 2247 - protein, 10 aa, Homo sapiens
DFIKATKVLM

SEQ ID NO: 2248 - protein, 10 aa, Homo sapiens
QLSDFGLERY

SEQ ID NO: 2249 - protein, 10 aa, Homo sapiens
PTKQSLVKVL

SEQ ID NO: 2250 - protein, 10 aa, Homo sapiens
KLEHFGISEY

SEQ ID NO: 2251 - protein, 10 aa, Homo sapiens
EDILQLLSKY

SEQ ID NO: 2252 - protein, 10 aa, Homo sapiens
QTLKDDVNIL

SEQ ID NO: 2253 - protein, 10 aa, Homo sapiens
DLEVEDRTSL

SEQ ID NO: 2254 - protein, 10 aa, Homo sapiens
DPSSPTISSY

SEQ ID NO: 2255 - protein, 10 aa, Homo sapiens
DGEESDFEDY

SEQ ID NO: 2256 - protein, 10 aa, Homo sapiens
IVTPPTKQSL

SEQ ID NO: 2257 - protein, 10 aa, Homo sapiens
STLDCETARL

SEQ ID NO: 2258 - protein, 10 aa, Homo sapiens
DLSDPPVASS

SEQ ID NO: 2259 - protein, 10 aa, Homo sapiens
ECVTPKLEHF

SEQ ID NO: 2260 - protein, 10 aa, Homo sapiens
LVPTFCTPGL

SEQ ID NO: 2261 - protein, 10 aa, Homo sapiens
PTISSYENLL

SEQ ID NO: 2262 - protein, 10 aa, Homo sapiens
KVLKTPKCAL

SEQ ID NO: 2263 - protein, 10 aa, Homo sapiens
DDFECVTPKL

SEQ ID NO: 2264 - protein, 10 aa, Homo sapiens
CLNEDYTMGL

SEQ ID NO: 2265 - protein, 10 aa, Homo sapiens
DTCFENLTDP

SEQ ID NO: 2266 - protein, 10 aa, Homo sapiens
DYPMRILYDL

SEQ ID NO: 2267 - protein, 10 aa, Homo sapiens
CTPGLKIPST

SEQ ID NO: 2268 - protein, 10 aa, Homo sapiens
QLLSKYNSNL

SEQ ID NO: 2269 - protein, 10 aa, Homo sapiens
ETARLQRALD

SEQ ID NO: 2270 - protein, 10 aa, Homo sapiens
TLKDDVNILL

SEQ ID NO: 2271 - protein, 10 aa, Homo sapiens
RLENQEGIDF

SEQ ID NO: 2272 - protein, 10 aa, Homo sapiens
MKIREYFQKY

SEQ ID NO: 2273 - protein, 10 aa, Homo sapiens
DVKDDLSDPP

SEQ ID NO: 2274 - protein, 10 aa, Homo sapiens
PVASSCISEK

SEQ ID NO: 2275 - protein, 10 aa, Homo sapiens
PNPPQAVNNY

SEQ ID NO: 2276 - protein, 10 aa, Homo sapiens
EHFGISEYTM

SEQ ID NO: 2277 - protein, 10 aa, Homo sapiens
DTESRLNDNV

SEQ ID NO: 2278 - protein, 10 aa, Homo sapiens
SLVLNSDTCF

SEQ ID NO: 2279 - protein, 10 aa, Homo sapiens
DPIRSFCGKL

SEQ ID NO: 2280 - protein, 10 aa, Homo sapiens
DVNILLDKAR

SEQ ID NO: 2281 - protein, 10 aa, Homo sapiens
DIMKIREYFQ

SEQ ID NO: 2282 - protein, 10 aa, Homo sapiens
RVKKNSVHEQ

SEQ ID NO: 2283 - protein, 10 aa, Homo sapiens
DPELSNCENF

SEQ ID NO: 2284 - protein, 10 aa, Homo sapiens
YIVSQVLPNP

SEQ ID NO: 2285 - protein, 10 aa, Homo sapiens
KTPKCALKMD

SEQ ID NO: 2286 - protein, 10 aa, Homo sapiens
EEAIDTESRL

SEQ ID NO: 2287 - protein, 10 aa, Homo sapiens
TKIPEDILQL

SEQ ID NO: 2288 - protein, 10 aa, Homo sapiens
DILQLLSKYN

SEQ ID NO: 2289 - protein, 10 aa, Homo sapiens
EVQTLKDDVN

SEQ ID NO: 2290 - protein, 10 aa, Homo sapiens
FIKATKVLME

SEQ ID NO: 2291 - protein, 10 aa, Homo sapiens
SMDIMKIREY

SEQ ID NO: 2292 - protein, 10 aa, Homo sapiens
SPRSPQLSDF

SEQ ID NO: 2293 - protein, 10 aa, Homo sapiens
DFGLERYIVS

SEQ ID NO: 2294 - protein, 10 aa, Homo sapiens
GISEYTMCLN

SEQ ID NO: 2295 - protein, 10 aa, Homo sapiens
EYTMCLNEDY

SEQ ID NO: 2296 - protein, 10 aa, Homo sapiens
PIAIKAVPPS

SEQ ID NO: 2297 - protein, 10 aa, Homo sapiens
RSFCGKLRSL

SEQ ID NO: 2298 - protein, 10 aa, Homo sapiens
EESDFEDYPM

SEQ ID NO: 2299 - protein, 10 aa, Homo sapiens
DLHSEVQTLK

SEQ ID NO: 2300 - protein, 10 aa, Homo sapiens
LLDKARLENQ

SEQ ID NO: 2301 - protein, 10 aa, Homo sapiens
ELSNCENFQK

SEQ ID NO: 2302 - protein, 10 aa, Homo sapiens
GLERYIVSQV

SEQ ID NO: 2303 - protein, 10 aa, Homo sapiens
QVLPNPPQAV

SEQ ID NO: 2304 - protein, 10 aa, Homo sapiens
VTPPTKQSLV

SEQ ID NO: 2305 - protein, 10 aa, Homo sapiens
PKCALKMDDF

SEQ ID NO: 2306 - protein, 10 aa, Homo sapiens
YTMGLKNARN

SEQ ID NO: 2307 - protein, 10 aa, Homo sapiens
RLNDNVFATP

SEQ ID NO: 2308 - protein, 10 aa, Homo sapiens
PIIQQLEKSD

SEQ ID NO: 2309 - protein, 10 aa, Homo sapiens
QQLEKSDAEY

SEQ ID NO: 2310 - protein, 10 aa, Homo sapiens
ALVSTNYPLS

SEQ ID NO: 2311 - protein, 10 aa, Homo sapiens
LNSDTCFENL

SEQ ID NO: 2312 - protein, 10 aa, Homo sapiens
ESDFEDYPMR

SEQ ID NO: 2313 - protein, 10 aa, Homo sapiens
YDLHSEVQTL

SEQ ID NO: 2314 - protein, 10 aa, Homo sapiens
LMEKNSMDIM

SEQ ID NO: 2315 - protein, 10 aa, Homo sapiens
EKNSMDIMKI

SEQ ID NO: 2316 - protein, 10 aa, Homo sapiens
SVHEQEAINS

SEQ ID NO: 2317 - protein, 10 aa, Homo sapiens
CISEKSPRSP

SEQ ID NO: 2318 - protein, 10 aa, Homo sapiens
PVIVTPPTKQ

SEQ ID NO: 2319 - protein, 10 aa, Homo sapiens
LVKVLKTPKC

SEQ ID NO: 2320 - protein, 10 aa, Homo sapiens
ALKMDDFECV

SEQ ID NO: 2321 - protein, 10 aa, Homo sapiens
VTPKLEHFGI

SEQ ID NO: 2322 - protein, 10 aa, Homo sapiens
NVFATPSPII

SEQ ID NO: 2323 - protein, 10 aa, Homo sapiens
PTFCTPGLKI

SEQ ID NO: 2324 - protein, 10 aa, Homo sapiens
KIPSTKNSIA

SEQ ID NO: 2325 - protein, 10 aa, Homo sapiens
NSIALVSTNY

SEQ ID NO: 2326 - protein, 10 aa, Homo sapiens
LTDPSSPTIS

SEQ ID NO: 2327 - protein, 10 aa, Homo sapiens
SPTISSYENL

SEQ ID NO: 2328 - protein, 10 aa, Homo sapiens
PTPPEVTKIP

SEQ ID NO: 2329 - protein, 10 aa, Homo sapiens
AIKAVPPSKR

SEQ ID NO: 2330 - protein, 10 aa, Homo sapiens
AVPPSKRFLK

SEQ ID NO: 2331 - protein, 10 aa, Homo sapiens
AVPPSKRFLK

SEQ ID NO: 2332 - protein, 10 aa, Homo sapiens
LVSTNYPLSK

SEQ ID NO: 2333 - protein, 10 aa, Homo sapiens
ELSNCENFQK

SEQ ID NO: 2334 - protein, 10 aa, Homo sapiens
PVASSCISEK

SEQ ID NO: 2335 - protein, 10 aa, Homo sapiens
VLKTPKCALK

SEQ ID NO: 2336 - protein, 10 aa, Homo sapiens
QKYGYSPRVK

SEQ ID NO: 2337 - protein, 10 aa, Homo sapiens
RLENQEGIDF

SEQ ID NO: 2338 - protein, 10 aa, Homo sapiens
SLVKVLKTPK

SEQ ID NO: 2339 - protein, 10 aa, Homo sapiens
KLEHFGISEY

SEQ ID NO: 2340 - protein, 10 aa, Homo sapiens
RLNDNVFATP

SEQ ID NO: 2341 - protein, 10 aa, Homo sapiens
RTPTPPEVTK

SEQ ID NO: 2342 - protein, 10 aa, Homo sapiens
AIKAVPPSKR

SEQ ID NO: 2343 - protein, 10 aa, Homo sapiens
ILYDLHSEVQ

SEQ ID NO: 2344 - protein, 10 aa, Homo sapiens
DLHSEVQTLK

SEQ ID NO: 2345 - protein, 10 aa, Homo sapiens
EGIDFIKATK

SEQ ID NO: 2346 - protein, 10 aa, Homo sapiens
ILLDKARLEN

SEQ ID NO: 2347 - protein, 10 aa, Homo sapiens
KVLMEKNSMD

SEQ ID NO: 2348 - protein, 10 aa, Homo sapiens
QLSDFGLERY

SEQ ID NO: 2349 - protein, 10 aa, Homo sapiens
GLERYIVSQV

SEQ ID NO: 2350 - protein, 10 aa, Homo sapiens
QVLPNPPQAV

SEQ ID NO: 2351 - protein, 10 aa, Homo sapiens
TPGLKIPSTK

SEQ ID NO: 2352 - protein, 10 aa, Homo sapiens
PIRSFCGKLR

SEQ ID NO: 2353 - protein, 10 aa, Homo sapiens
RLQRALDGEE

SEQ ID NO: 2354 - protein, 10 aa, Homo sapiens
KYGYSPRVKK

SEQ ID NO: 2355 - protein, 10 aa, Homo sapiens
VLPNPPQAVN

SEQ ID NO: 2356 - protein, 10 aa, Homo sapiens
EVEDRTSLVL

SEQ ID NO: 2357 - protein, 10 aa, Homo sapiens
SNLATPIAIK

SEQ ID NO: 2358 - protein, 10 aa, Homo sapiens
IAIKAVPPSK

SEQ ID NO: 2359 - protein, 10 aa, Homo sapiens
KLRSLASTLD

SEQ ID NO: 2360 - protein, 10 aa, Homo sapiens
RILYDLHSEV

SEQ ID NO: 2361 - protein, 10 aa, Homo sapiens
IMKIREYFQK

SEQ ID NO: 2362 - protein, 10 aa, Homo sapiens
IVTPPTKQSL

SEQ ID NO: 2363 - protein, 10 aa, Homo sapiens
TPPTKQSLVK

SEQ ID NO: 2364 - protein, 10 aa, Homo sapiens
SLVLNSDTCF

SEQ ID NO: 2365 - protein, 10 aa, Homo sapiens
QLLSKYNSNL

SEQ ID NO: 2366 - protein, 10 aa, Homo sapiens
KDDVNILLDK

SEQ ID NO: 2367 - protein, 10 aa, Homo sapiens
DVNILLDKAR

SEQ ID NO: 2368 - protein, 10 aa, Homo sapiens
AINSDPELSN

SEQ ID NO: 2369 - protein, 10 aa, Homo sapiens
DLSDPPVASS

SEQ ID NO: 2370 - protein, 10 aa, Homo sapiens
EPVIVTPPTK

SEQ ID NO: 2371 - protein, 10 aa, Homo sapiens
KVLKTPKCAL

SEQ ID NO: 2372 - protein, 10 aa, Homo sapiens
PEDILQLLSK

SEQ ID NO: 2373 - protein, 10 aa, Homo sapiens
GKLRSLASTL

SEQ ID NO: 2374 - protein, 10 aa, Homo sapiens
ALDGEESDFE

SEQ ID NO: 2375 - protein, 10 aa, Homo sapiens
FIKATKVLME

SEQ ID NO: 2376 - protein, 10 aa, Homo sapiens
KIREYFQKYG

SEQ ID NO: 2377 - protein, 10 aa, Homo sapiens
SPRVKKNSVH

SEQ ID NO: 2378 - protein, 10 aa, Homo sapiens
RVKKNSVHEQ

SEQ ID NO: 2379 - protein, 10 aa, Homo sapiens
SVHEQEAINS

SEQ ID NO: 2380 - protein, 10 aa, Homo sapiens
PVIVTPPTKQ

SEQ ID NO: 2381 - protein, 10 aa, Homo sapiens
AIDTESRLND

SEQ ID NO: 2382 - protein, 10 aa, Homo sapiens
QLEKSDAEYT

SEQ ID NO: 2383 - protein, 10 aa, Homo sapiens
AEYTNSPLVP

SEQ ID NO: 2384 - protein, 10 aa, Homo sapiens
PLSKTNSSSN

SEQ ID NO: 2385 - protein, 10 aa, Homo sapiens
NLTDPSSPTI

SEQ ID NO: 2386 - protein, 10 aa, Homo sapiens
TISSYENLLR

SEQ ID NO: 2387 - protein, 10 aa, Homo sapiens
NLLRTPTPPE

SEQ ID NO: 2388 - protein, 10 aa, Homo sapiens
RALDGEESDF

SEQ ID NO: 2389 - protein, 10 aa, Homo sapiens
EVQTLKDDVN

SEQ ID NO: 2390 - protein, 10 aa, Homo sapiens
NILLDKARLE

SEQ ID NO: 2391 - protein, 10 aa, Homo sapiens
IKATKVLMEK

SEQ ID NO: 2392 - protein, 10 aa, Homo sapiens
CENFQKTDVK

SEQ ID NO: 2393 - protein, 10 aa, Homo sapiens
AVNNYKEEPV

SEQ ID NO: 2394 - protein, 10 aa, Homo sapiens
TKQSLVKVLK

SEQ ID NO: 2395 - protein, 10 aa, Homo sapiens
ALKMDDFECV

SEQ ID NO: 2396 - protein, 10 aa, Homo sapiens
PSPIIQQLEK

SEQ ID NO: 2397 - protein, 10 aa, Homo sapiens
QQLEKSDAEY

SEQ ID NO: 2398 - protein, 10 aa, Homo sapiens
PLVPTFCTPG

SEQ ID NO: 2399 - protein, 10 aa, Homo sapiens
KIPSTKNSIA

SEQ ID NO: 2400 - protein, 10 aa, Homo sapiens
DLEVEDRTSL

SEQ ID NO: 2401 - protein, 10 aa, Homo sapiens
LLRTPTPPEV

SEQ ID NO: 2402 - protein, 10 aa, Homo sapiens
NLATPIAIKA

SEQ ID NO: 2403 - protein, 10 aa, Homo sapiens
GQNIRDVSNK

SEQ ID NO: 2404 - protein, 10 aa, Homo sapiens
TLDCETARLQ

SEQ ID NO: 2405 - protein, 10 aa, Homo sapiens
MEKNSMDIMK

SEQ ID NO: 2406 - protein, 10 aa, Homo sapiens
IVSQVLPNPP

SEQ ID NO: 2407 - protein, 10 aa, Homo sapiens
CVTPKLEHFG

SEQ ID NO: 2408 - protein, 10 aa, Homo sapiens
MGLKNARNNK

SEQ ID NO: 2409 - protein, 10 aa, Homo sapiens
PIIQQLEKSD

SEQ ID NO: 2410 - protein, 10 aa, Homo sapiens
IIQQLEKSDA

SEQ ID NO: 2411 - protein, 10 aa, Homo sapiens
STKNSIALVS

SEQ ID NO: 2412 - protein, 10 aa, Homo sapiens
ALVSTNYPLS

SEQ ID NO: 2413 - protein, 10 aa, Homo sapiens
LVLNSDTCFE

SEQ ID NO: 2414 - protein, 10 aa, Homo sapiens
EDILQLLSKY

SEQ ID NO: 2415 - protein, 10 aa, Homo sapiens
ILQLLSKYNS

SEQ ID NO: 2416 - protein, 10 aa, Homo sapiens
SKYNSNLATP

SEQ ID NO: 2417 - protein, 10 aa, Homo sapiens
IPSTKNSIAL

SEQ ID NO: 2418 - protein, 10 aa, Homo sapiens
DPIRSFCGKL

SEQ ID NO: 2419 - protein, 10 aa, Homo sapiens
SPTISSYENL

SEQ ID NO: 2420 - protein, 10 aa, Homo sapiens
PPTKQSLVKV

SEQ ID NO: 2421 - protein, 10 aa, Homo sapiens
TPTPPEVTKI

SEQ ID NO: 2422 - protein, 10 aa, Homo sapiens
SPRSPQLSDF

SEQ ID NO: 2423 - protein, 10 aa, Homo sapiens
DPELSNCENF

SEQ ID NO: 2424 - protein, 10 aa, Homo sapiens
EVEDRTSLVL

SEQ ID NO: 2425 - protein, 10 aa, Homo sapiens
TPIAIKAVPP

SEQ ID NO: 2426 - protein, 10 aa, Homo sapiens
IDFIKATKVL

SEQ ID NO: 2427 - protein, 10 aa, Homo sapiens
SPRVKKNSVH

SEQ ID NO: 2428 - protein, 10 aa, Homo sapiens
LERYIVSQVL

SEQ ID NO: 2429 - protein, 10 aa, Homo sapiens
LPNPPQAVNN

SEQ ID NO: 2430 - protein, 10 aa, Homo sapiens
TPPTKQSLVK

SEQ ID NO: 2431 - protein, 10 aa, Homo sapiens
KVLKTPKCAL

SEQ ID NO: 2432 - protein, 10 aa, Homo sapiens
TPSPIIQQLE

SEQ ID NO: 2433 - protein, 10 aa, Homo sapiens
LNSDTCFENL

SEQ ID NO: 2434 - protein, 10 aa, Homo sapiens
TKIPEDILQL

SEQ ID NO: 2435 - protein, 10 aa, Homo sapiens
IPEDILQLLS

SEQ ID NO: 2436 - protein, 10 aa, Homo sapiens
KAVPPSKRFL

SEQ ID NO: 2437 - protein, 10 aa, Homo sapiens
VPPSKRFLKH

SEQ ID NO: 2438 - protein, 10 aa, Homo sapiens
PPSKRFLKHG

SEQ ID NO: 2439 - protein, 10 aa, Homo sapiens
STLDCETARL

SEQ ID NO: 2440 - protein, 10 aa, Homo sapiens
CETARLQRAL

SEQ ID NO: 2441 - protein, 10 aa, Homo sapiens
QTLKDDVNIL

SEQ ID NO: 2442 - protein, 10 aa, Homo sapiens
QEAINSDPEL

SEQ ID NO: 2443 - protein, 10 aa, Homo sapiens
EPVIVTPPTK

SEQ ID NO: 2444 - protein, 10 aa, Homo sapiens
IVTPPTKQSL

SEQ ID NO: 2445 - protein, 10 aa, Homo sapiens
PTKQSLVKVL

SEQ ID NO: 2446 - protein, 10 aa, Homo sapiens
KQSLVKVLKT

SEQ ID NO: 2447 - protein, 10 aa, Homo sapiens
DDFECVTPKL

SEQ ID NO: 2448 - protein, 10 aa, Homo sapiens
EEAIDTESRL

SEQ ID NO: 2449 - protein, 10 aa, Homo sapiens
ESRLNDNVFA

SEQ ID NO: 2450 - protein, 10 aa, Homo sapiens
ATPSPIIQQL

SEQ ID NO: 2451 - protein, 10 aa, Homo sapiens
SDAEYTNSPL

SEQ ID NO: 2452 - protein, 10 aa, Homo sapiens
LVPTFCTPGL

SEQ ID NO: 2453 - protein, 10 aa, Homo sapiens
IALVSTNYPL

SEQ ID NO: 2454 - protein, 10 aa, Homo sapiens
DLEVEDRTSL

SEQ ID NO: 2455 - protein, 10 aa, Homo sapiens
DPSSPTISSY

SEQ ID NO: 2456 - protein, 10 aa, Homo sapiens
EVTKIPEDIL

SEQ ID NO: 2457 - protein, 9 aa, Homo sapiens
GKSPRSPQL

SEQ ID NO: 2458 - protein, 9 aa, Homo sapiens
GKSPRSPQL

SEQ ID NO: 2459 - protein, 9 aa, Homo sapiens
GKSPRSPQL

SEQ ID NO: 2460 - protein, 9 aa, Homo sapiens
CISGKSPRS

SEQ ID NO: 2461 - protein, 9 aa, Homo sapiens
GKSPRSPQL

SEQ ID NO: 2462 - protein, 9 aa, Homo sapiens
GKSPRSPQL

SEQ ID NO: 2463 - protein, 9 aa, Homo sapiens
SCISGKSPR

SEQ ID NO: 2464 - protein, 9 aa, Homo sapiens
VASSCISGK

SEQ ID NO: 2465 - protein, 9 aa, Homo sapiens
GKSPRSPQL

SEQ ID NO: 2466 - protein, 9 aa, Homo sapiens
VASSCISGK

SEQ ID NO: 2467 - protein, 10 aa, Homo sapiens
CISGKSPRSP

SEQ ID NO: 2468 - protein, 10 aa, Homo sapiens
SGKSPRSPQL

SEQ ID NO: 2469 - protein, 10 aa, Homo sapiens
PVASSCISGK

SEQ ID NO: 2470 - protein, 10 aa, Homo sapiens
CISGKSPRSP

SEQ ID NO: 2471 - protein, 10 aa, Homo sapiens
PVASSCISGK

SEQ ID NO: 2472 - protein, 10 aa, Homo sapiens
CISGKSPRSP

SEQ ID NO: 2473 - protein, 9 aa, Homo sapiens
EAIDAESRL

SEQ ID NO: 2474 - protein, 9 aa, Homo sapiens
AESRLNDNV

SEQ ID NO: 2475 - protein, 9 aa, Homo sapiens
NKSEEAIDA

SEQ ID NO: 2476 - protein, 9 aa, Homo sapiens
EAIDAESRL

SEQ ID NO: 2477 - protein, 9 aa, Homo sapiens
EAIDAESRL

SEQ ID NO: 2478 - protein, 9 aa, Homo sapiens
EAIDAESRL

SEQ ID NO: 2479 - protein, 9 aa, Homo sapiens
EAIDAESRL

SEQ ID NO: 2480 - protein, 9 aa, Homo sapiens
EAIDAESRL

SEQ ID NO: 2481 - protein, 9 aa, Homo sapiens
EEAIDAESR

SEQ ID NO: 2482 - protein, 9 aa, Homo sapiens
EAIDAESRL

SEQ ID NO: 2483 - protein, 9 aa, Homo sapiens
EAIDAESRL

SEQ ID NO: 2484 - protein, 9 aa, Homo sapiens
DAESRLNDN

SEQ ID NO: 2485 - protein, 19 aa, Artificial Sequence
  Description of Artificial Sequence: 193P1E1B variant 2 amino acid sequence
NNKSEEAIDAESRLNDNVF

SEQ ID NO: 2486 - protein, 10 aa, Homo sapiens
DAESRLNDNV

SEQ ID NO: 2487 - protein, 10 aa, Homo sapiens
NNKSEEAIDA

SEQ ID NO: 2488 - protein, 10 aa, Homo sapiens
NKSEEAIDAE

SEQ ID NO: 2489 - protein, 10 aa, Homo sapiens
KSEEAIDAES

SEQ ID NO: 2490 - protein, 10 aa, Homo sapiens
AIDAESRLND

SEQ ID NO: 2491 - protein, 10 aa, Homo sapiens
EEAIDAESRL

SEQ ID NO: 2492 - protein, 10 aa, Homo sapiens
AIDAESRLND

SEQ ID NO: 2493 - protein, 10 aa, Homo sapiens
AESRLNDNVF

SEQ ID NO: 2494 - protein, 10 aa, Homo sapiens
EEAIDAESRL

SEQ ID NO: 2495 - protein, 9 aa, Homo sapiens
DILQKFQWI

SEQ ID NO: 2496 - protein, 9 aa, Homo sapiens
KIPEDILQK

SEQ ID NO: 2497 - protein, 9 aa, Homo sapiens
QWIYPTQKL

SEQ ID NO: 2498 - protein, 9 aa, Homo sapiens
ILQKFQWIY

SEQ ID NO: 2499 - protein, 9 aa, Homo sapiens
YPTQKLNKM

SEQ ID NO: 2500 - protein, 9 aa, Homo sapiens
ILQKFQWIY

SEQ ID NO: 2501 - protein, 9 aa, Homo sapiens
DILQKFQWI

SEQ ID NO: 2502 - protein, 9 aa, Homo sapiens
ILQKFQWIY

SEQ ID NO: 2503 - protein, 9 aa, Homo sapiens
KIPEDILQK

SEQ ID NO: 2504 - protein, 9 aa, Homo sapiens
IPEDILQKF

SEQ ID NO: 2505 - protein, 9 aa, Homo sapiens
KIPEDILQK

SEQ ID NO: 2506 - protein, 9 aa, Homo sapiens
ILQKFQWIY

SEQ ID NO: 2507 - protein, 9 aa, Homo sapiens
FQWIYPTQK

SEQ ID NO: 2508 - protein, 9 aa, Homo sapiens
WIYPTQKLN

SEQ ID NO: 2509 - protein, 9 aa, Homo sapiens
IYPTQKLNK

SEQ ID NO: 2510 - protein, 9 aa, Homo sapiens
IPEDILQKF

SEQ ID NO: 2511 - protein, 9 aa, Homo sapiens
YPTQKLNKM

SEQ ID NO: 2512 - protein, 9 aa, Homo sapiens
QWIYPTQKL

SEQ ID NO: 2513 - protein, 9 aa, Homo sapiens
DILQKFQWI

SEQ ID NO: 2514 - protein, 9 aa, Homo sapiens
YPTQKLNKM

SEQ ID NO: 2515 - protein, 9 aa, Homo sapiens
QWIYPTQKL

SEQ ID NO: 2516 - protein, 9 aa, Homo sapiens
IPEDILQKF

SEQ ID NO: 2517 - protein, 9 aa, Homo sapiens
YPTQKLNKM

SEQ ID NO: 2518 - protein, 9 aa, Homo sapiens
KIPEDILQK

SEQ ID NO: 2519 - protein, 9 aa, Homo sapiens
IPEDILQKF

SEQ ID NO: 2520 - protein, 9 aa, Homo sapiens
QWIYPTQKL

SEQ ID NO: 2521 - protein, 9 aa, Homo sapiens
IYPTQKLNK

SEQ ID NO: 2522 - protein, 9 aa, Homo sapiens
YPTQKLNKM

SEQ ID NO: 2523 - protein, 9 aa, Homo sapiens
ILQKFQWIY

SEQ ID NO: 2524 - protein, 9 aa, Homo sapiens
PTQKLNKMR

SEQ ID NO: 2525 - protein, 9 aa, Homo sapiens
FQWIYPTQK

SEQ ID NO: 2526 - protein, 9 aa, Homo sapiens
QWIYPTQKL

SEQ ID NO: 2527 - protein, 9 aa, Homo sapiens
DILQKFQWI

SEQ ID NO: 2528 - protein, 9 aa, Homo sapiens
YPTQKLNKM

SEQ ID NO: 2529 - protein, 9 aa, Homo sapiens
IPEDILQKF

SEQ ID NO: 2530 - protein, 10 aa, Homo sapiens
KIPEDILQKF

SEQ ID NO: 2531 - protein, 10 aa, Homo sapiens
FQWIYPTQKL

SEQ ID NO: 2532 - protein, 10 aa, Homo sapiens
IYPTQKLNKM

SEQ ID NO: 2533 - protein, 10 aa, Homo sapiens
ILQKFQWIYP

SEQ ID NO: 2534 - protein, 10 aa, Homo sapiens
WIYPTQKLNK

SEQ ID NO: 2535 - protein, 10 aa, Homo sapiens
KIPEDILQKF

SEQ ID NO: 2536 - protein, 10 aa, Homo sapiens
DILQKFQWIY

SEQ ID NO: 2537 - protein, 10 aa, Homo sapiens
IYPTQKLNKM

SEQ ID NO: 2538 - protein, 10 aa, Homo sapiens
EDILQKFQWI

SEQ ID NO: 2539 - protein, 10 aa, Homo sapiens
WIYPTQKLNK

SEQ ID NO: 2540 - protein, 10 aa, Homo sapiens
WIYPTQKLNK

SEQ ID NO: 2541 - protein, 10 aa, Homo sapiens
TKIPEDILQK

SEQ ID NO: 2542 - protein, 10 aa, Homo sapiens
KFQWIYPTQK

SEQ ID NO: 2543 - protein, 10 aa, Homo sapiens
KIPEDILQKF

SEQ ID NO: 2544 - protein, 10 aa, Homo sapiens
DILQKFQWIY

SEQ ID NO: 2545 - protein, 10 aa, Homo sapiens
IPEDILQKFQ

SEQ ID NO: 2546 - protein, 9 aa, Homo sapiens
ALDGEESLL

SEQ ID NO: 2547 - protein, 9 aa, Homo sapiens
RALDGEESL

SEQ ID NO: 2548 - protein, 9 aa, Homo sapiens
SLLSKYNSN

SEQ ID NO: 2549 - protein, 9 aa, Homo sapiens
GEESLLSKY

SEQ ID NO: 2550 - protein, 9 aa, Homo sapiens
DGEESLLSK

SEQ ID NO: 2551 - protein, 9 aa, Homo sapiens
ALDGEESLL

SEQ ID NO: 2552 - protein, 9 aa, Homo sapiens
ALDGEESLL

SEQ ID NO: 2553 - protein, 9 aa, Homo sapiens
GEESLLSKY

SEQ ID NO: 2554 - protein, 9 aa, Homo sapiens
ALDGEESLL

SEQ ID NO: 2555 - protein, 9 aa, Homo sapiens
DGEESLLSK

SEQ ID NO: 2556 - protein, 9 aa, Homo sapiens
SLLSKYNSN

SEQ ID NO: 2557 - protein, 9 aa, Homo sapiens
ALDGEESLL

SEQ ID NO: 2558 - protein, 9 aa, Homo sapiens
RALDGEESL

SEQ ID NO: 2559 - protein, 9 aa, Homo sapiens
SLLSKYNSN

SEQ ID NO: 2560 - protein, 9 aa, Homo sapiens
ALDGEESLL

SEQ ID NO: 2561 - protein, 9 aa, Homo sapiens
RALDGEESL

SEQ ID NO: 2562 - protein, 9 aa, Homo sapiens
RALDGEESL

SEQ ID NO: 2563 - protein, 9 aa, Homo sapiens
ALDGEESLL

SEQ ID NO: 2564 - protein, 9 aa, Homo sapiens
RALDGEESL

SEQ ID NO: 2565 - protein, 9 aa, Homo sapiens
GEESLLSKY

SEQ ID NO: 2566 - protein, 9 aa, Homo sapiens
ALDGEESLL

SEQ ID NO: 2567 - protein, 9 aa, Homo sapiens
DGEESLLSK

SEQ ID NO: 2568 - protein, 9 aa, Homo sapiens
RALDGEESL

SEQ ID NO: 2569 - protein, 9 aa, Homo sapiens
ALDGEESLL

SEQ ID NO: 2570 - protein, 9 aa, Homo sapiens
RALDGEESL

SEQ ID NO: 2571 - protein, 9 aa, Homo sapiens
DGEESLLSK

SEQ ID NO: 2572 - protein, 10 aa, Homo sapiens
SLLSKYNSNL

SEQ ID NO: 2573 - protein, 10 aa, Homo sapiens
RALDGEESLL

SEQ ID NO: 2574 - protein, 10 aa, Homo sapiens
ALDGEESLLS

SEQ ID NO: 2575 - protein, 10 aa, Homo sapiens
QRALDGEESL

SEQ ID NO: 2576 - protein, 10 aa, Homo sapiens
DGEESLLSKY

SEQ ID NO: 2577 - protein, 10 aa, Homo sapiens
ALDGEESLLS

SEQ ID NO: 2578 - protein, 10 aa, Homo sapiens
GEESLLSKYN

SEQ ID NO: 2579 - protein, 10 aa, Homo sapiens
DGEESLLSKY

SEQ ID NO: 2580 - protein, 10 aa, Homo sapiens
SLLSKYNSNL

SEQ ID NO: 2581 - protein, 10 aa, Homo sapiens
ALDGEESLLS

SEQ ID NO: 2582 - protein, 10 aa, Homo sapiens
LDGEESLLSK

SEQ ID NO: 2583 - protein, 10 aa, Homo sapiens
SLLSKYNSNL

SEQ ID NO: 2584 - protein, 15 aa, Homo sapiens
QEGIDFIKATKVLME

SEQ ID NO: 2585 - protein, 15 aa, Homo sapiens
KARLENQEGIDFIKA

SEQ ID NO: 2586 - protein, 15 aa, Homo sapiens
KNSVHEQEAINSDPE

SEQ ID NO: 2587 - protein, 15 aa, Homo sapiens
DYPMRILYDLHSEVQ

SEQ ID NO: 2588 - protein, 15 aa, Homo sapiens
KNSIALVSTNYPLSK

SEQ ID NO: 2589 - protein, 15 aa, Homo sapiens
RYIVSQVLPNPPQAV

SEQ ID NO: 2590 - protein, 15 aa, Homo sapiens
LSKYNSNLATPIAIK

SEQ ID NO: 2591 - protein, 15 aa, Homo sapiens
TPGLKIPSTKNSIAL

SEQ ID NO: 2592 - protein, 15 aa, Homo sapiens
ARLQRALDGEESDFE

SEQ ID NO: 2593 - protein, 15 aa, Homo sapiens
IREYFQKYGYSPRVK

SEQ ID NO: 2594 - protein, 15 aa, Homo sapiens
DTCFENLTDPSSPTI

SEQ ID NO: 2595 - protein, 15 aa, Homo sapiens
CGKLRSLASTLDCET

SEQ ID NO: 2596 - protein, 15 aa, Homo sapiens
TMCLNEDYTMGLKNA

SEQ ID NO: 2597 - protein, 15 aa, Homo sapiens
SPIIQQLEKSDAEYT

SEQ ID NO: 2598 - protein, 15 aa, Homo sapiens
STNYPLSKTNSSSND

SEQ ID NO: 2599 - protein, 15 aa, Homo sapiens
PPEVTKIPEDILQLL

SEQ ID NO: 2600 - protein, 15 aa, Homo sapiens
EDILQLLSKYNSNLA

SEQ ID NO: 2601 - protein, 15 aa, Homo sapiens
NSNLATPIAIKAVPP

SEQ ID NO: 2602 - protein, 15 aa, Homo sapiens
RSFCGKLRSLASTLD

SEQ ID NO: 2603 - protein, 15 aa, Homo sapiens
EPVIVTPPTKQSLVK

SEQ ID NO: 2604 - protein, 15 aa, Homo sapiens
QSLVKVLKTPKCALK

SEQ ID NO: 2605 - protein, 15 aa, Homo sapiens
SPLVPTFCTPGLKIP

SEQ ID NO: 2606 - protein, 15 aa, Homo sapiens
SSYENLLRTPTPPEV

SEQ ID NO: 2607 - protein, 15 aa, Homo sapiens
ENLLRTPTPPEVTKI

SEQ ID NO: 2608 - protein, 15 aa, Homo sapiens
LQLLSKYNSNLATPI

SEQ ID NO: 2609 - protein, 15 aa, Homo sapiens
KTDVKDDLSDPPVAS

SEQ ID NO: 2610 - protein, 15 aa, Homo sapiens
SSCISEKSPRSPQLS

SEQ ID NO: 2611 - protein, 15 aa, Homo sapiens
ERYIVSQVLPNPPQA

SEQ ID NO: 2612 - protein, 15 aa, Homo sapiens
MDDFECVTPKLEHFG

SEQ ID NO: 2613 - protein, 15 aa, Homo sapiens
SRLNDNVFATPSPII

SEQ ID NO: 2614 - protein, 15 aa, Homo sapiens
FENLTDPSSPTISSY

SEQ ID NO: 2615 - protein, 15 aa, Homo sapiens
PEDILQLLSKYNSNL

SEQ ID NO: 2616 - protein, 15 aa, Homo sapiens
MRILYDLHSEVQTLK

SEQ ID NO: 2617 - protein, 15 aa, Homo sapiens
TKVLMEKNSMDIMKI

SEQ ID NO: 2618 - protein, 15 aa, Homo sapiens
FGLERYIVSQVLPNP

SEQ ID NO: 2619 - protein, 15 aa, Homo sapiens
VSQVLPNPPQAVNNY

SEQ ID NO: 2620 - protein, 15 aa, Homo sapiens
NDNVFATPSPIIQQL

SEQ ID NO: 2621 - protein, 15 aa, Homo sapiens
DLEVEDRTSLVLNSD

SEQ ID NO: 2622 - protein, 15 aa, Homo sapiens
SKYNSNLATPIAIKA

SEQ ID NO: 2623 - protein, 15 aa, Homo sapiens
LATPIAIKAVPPSKR

SEQ ID NO: 2624 - protein, 15 aa, Homo sapiens
PIAIKAVPPSKRFLK

SEQ ID NO: 2625 - protein, 15 aa, Homo sapiens
KDDVNILLDKARLEN

SEQ ID NO: 2626 - protein, 15 aa, Homo sapiens
ECVTPKLEHFGISEY

SEQ ID NO: 2627 - protein, 15 aa, Homo sapiens
GIDFIKATKVLMEKN

SEQ ID NO: 2628 - protein, 15 aa, Homo sapiens
DLSDPPVASSCISEK

SEQ ID NO: 2629 - protein, 15 aa, Homo sapiens
VPTFCTPGLKIPSTK

SEQ ID NO: 2630 - protein, 15 aa, Homo sapiens
MDPIRSFCGKLRSLA

SEQ ID NO: 2631 - protein, 15 aa, Homo sapiens
ESDFEDYPMRILYDL

SEQ ID NO: 2632 - protein, 15 aa, Homo sapiens
FEDYPMRILYDLHSE

SEQ ID NO: 2633 - protein, 15 aa, Homo sapiens
KYGYSPRVKKNSVHE

SEQ ID NO: 2634 - protein, 15 aa, Homo sapiens
LSDFGLERYIVSQVL

SEQ ID NO: 2635 - protein, 15 aa, Homo sapiens
RTSLVLNSDTCFENL

SEQ ID NO: 2636 - protein, 15 aa, Homo sapiens
ISSYENLLRTPTPPE

SEQ ID NO: 2637 - protein, 15 aa, Homo sapiens
ATPIAIKAVPPSKRF

SEQ ID NO: 2638 - protein, 15 aa, Homo sapiens
IRSFCGKLRSLASTL

SEQ ID NO: 2639 - protein, 15 aa, Homo sapiens
DVNILLDKARLENQE

SEQ ID NO: 2640 - protein, 15 aa, Homo sapiens
EGIDFIKATKVLMEK

SEQ ID NO: 2641 - protein, 15 aa, Homo sapiens
IKATKVLMEKNSMDI

SEQ ID NO: 2642 - protein, 15 aa, Homo sapiens
KVLMEKNSMDIMKIR

SEQ ID NO: 2643 - protein, 15 aa, Homo sapiens
KNSMDIMKIREYFQK

SEQ ID NO: 2644 - protein, 15 aa, Homo sapiens
SPRSPQLSDFGLERY

SEQ ID NO: 2645 - protein, 15 aa, Homo sapiens
VTPPTKQSLVKVLKT

SEQ ID NO: 2646 - protein, 15 aa, Homo sapiens
KQSLVKVLKTPKCAL

SEQ ID NO: 2647 - protein, 15 aa, Homo sapiens
LVKVLKTPKCALKMD

SEQ ID NO: 2648 - protein, 15 aa, Homo sapiens
KVLKTPKCALKMDDF

SEQ ID NO: 2649 - protein, 15 aa, Homo sapiens
KCALKMDDFECVTPK

SEQ ID NO: 2650 - protein, 15 aa, Homo sapiens
EYTMCLNEDYTMGLK

SEQ ID NO: 2651 - protein, 15 aa, Homo sapiens
DYTMGLKNARNNKSE

SEQ ID NO: 2652 - protein, 15 aa, Homo sapiens
TMGLKNARNNKSEEA

SEQ ID NO: 2653 - protein, 15 aa, Homo sapiens
TPSPIIQQLEKSDAE

SEQ ID NO: 2654 - protein, 15 aa, Homo sapiens
IQQLEKSDAEYTNSP

SEQ ID NO: 2655 - protein, 15 aa, Homo sapiens
ASTLDCETARLQRAL

SEQ ID NO: 2656 - protein, 15 aa, Homo sapiens
CETARLQRALDGEES

SEQ ID NO: 2657 - protein, 15 aa, Homo sapiens
VQTLKDDVNILLDKA

SEQ ID NO: 2658 - protein, 15 aa, Homo sapiens
DDVNILLDKARLENQ

SEQ ID NO: 2659 - protein, 15 aa, Homo sapiens
KATKVLMEKNSMDIM

SEQ ID NO: 2660 - protein, 15 aa, Homo sapiens
QLSDFGLERYIVSQV

SEQ ID NO: 2661 - protein, 15 aa, Homo sapiens
GLERYIVSQVLPNPP

SEQ ID NO: 2662 - protein, 15 aa, Homo sapiens
PQAVNNYKEEPVIVT

SEQ ID NO: 2663 - protein, 15 aa, Homo sapiens
AVNNYKEEPVIVTPP

SEQ ID NO: 2664 - protein, 15 aa, Homo sapiens
PVIVTPPTKQSLVKV

SEQ ID NO: 2665 - protein, 15 aa, Homo sapiens
SLVKVLKTPKCALKM

SEQ ID NO: 2666 - protein, 15 aa, Homo sapiens
ALKMDDFECVTPKLE

SEQ ID NO: 2667 - protein, 15 aa, Homo sapiens
ESRLNDNVFATPSPI

SEQ ID NO: 2668 - protein, 15 aa, Homo sapiens
LVPTFCTPGLKIPST

SEQ ID NO: 2669 - protein, 15 aa, Homo sapiens
IPSTKNSIALVSTNY

SEQ ID NO: 2670 - protein, 15 aa, Homo sapiens
SIALVSTNYPLSKTN

SEQ ID NO: 2671 - protein, 15 aa, Homo sapiens
VSTNYPLSKTNSSSN

SEQ ID NO: 2672 - protein, 15 aa, Homo sapiens
SNDLEVEDRTSLVLN

SEQ ID NO: 2673 - protein, 15 aa, Homo sapiens
PSKRFLKHGQNIRDV

SEQ ID NO: 2674 - protein, 15 aa, Homo sapiens
FCGKLRSLASTLDCE

SEQ ID NO: 2675 - protein, 15 aa, Homo sapiens
RSLASTLDCETARLQ

SEQ ID NO: 2676 - protein, 15 aa, Homo sapiens
PMRILYDLHSEVQTL

SEQ ID NO: 2677 - protein, 15 aa, Homo sapiens
HSEVQTLKDDVNILL

SEQ ID NO: 2678 - protein, 15 aa, Homo sapiens
LKDDVNILLDKARLE

SEQ ID NO: 2679 - protein, 15 aa, Homo sapiens
LMEKNSMDIMKIREY

SEQ ID NO: 2680 - protein, 15 aa, Homo sapiens
SMDIMKIREYFQKYG

SEQ ID NO: 2681 - protein, 15 aa, Homo sapiens
TDVKDDLSDPPVASS

SEQ ID NO: 2682 - protein, 15 aa, Homo sapiens
KDDLSDPPVASSCIS

SEQ ID NO: 2683 - protein, 15 aa, Homo sapiens
DFGLERYIVSQVLPN

SEQ ID NO: 2684 - protein, 15 aa, Homo sapiens
IVSQVLPNPPQAVNN

SEQ ID NO: 2685 - protein, 15 aa, Homo sapiens
KEEPVIVTPPTKQSL

SEQ ID NO: 2686 - protein, 15 aa, Homo sapiens
EEPVIVTPPTKQSLV

SEQ ID NO: 2687 - protein, 15 aa, Homo sapiens
KTPKCALKMDDFECV

SEQ ID NO: 2688 - protein, 15 aa, Homo sapiens
LNEDYTMGLKNARNN

SEQ ID NO: 2689 - protein, 15 aa, Homo sapiens
LKNARNNKSEEAIDT

SEQ ID NO: 2690 - protein, 15 aa, Homo sapiens
IDTESRLNDNVFATP

SEQ ID NO: 2691 - protein, 15 aa, Homo sapiens
LNDNVFATPSPIIQQ

SEQ ID NO: 2692 - protein, 15 aa, Homo sapiens
DNVFATPSPIIQQLE

SEQ ID NO: 2693 - protein, 15 aa, Homo sapiens
CTPGLKIPSTKNSIA

SEQ ID NO: 2694 - protein, 15 aa, Homo sapiens
GLKIPSTKNSIALVS

SEQ ID NO: 2695 - protein, 15 aa, Homo sapiens
NYPLSKTNSSSNDLE

SEQ ID NO: 2696 - protein, 15 aa, Homo sapiens
SSNDLEVEDRTSLVL

SEQ ID NO: 2697 - protein, 15 aa, Homo sapiens
TCFENLTDPSSPTIS

SEQ ID NO: 2698 - protein, 15 aa, Homo sapiens
SYENLLRTPTPPEVT

SEQ ID NO: 2699 - protein, 15 aa, Homo sapiens
VTKIPEDILQLLSKY

SEQ ID NO: 2700 - protein, 15 aa, Homo sapiens
ILQLLSKYNSNLATP

SEQ ID NO: 2701 - protein, 15 aa, Homo sapiens
KYNSNLATPIAIKAV

SEQ ID NO: 2702 - protein, 15 aa, Homo sapiens
SNLATPIAIKAVPPS

SEQ ID NO: 2703 - protein, 15 aa, Homo sapiens
VQTLKDDVNILLDKA

SEQ ID NO: 2704 - protein, 15 aa, Homo sapiens
VTKIPEDILQLLSKY

SEQ ID NO: 2705 - protein, 15 aa, Homo sapiens
QEAINSDPELSNCEN

SEQ ID NO: 2706 - protein, 15 aa, Homo sapiens
TMCLNEDYTMGLKNA

SEQ ID NO: 2707 - protein, 15 aa, Homo sapiens
LVKVLKTPKCALKMD

SEQ ID NO: 2708 - protein, 15 aa, Homo sapiens
ILQLLSKYNSNLATP

SEQ ID NO: 2709 - protein, 15 aa, Homo sapiens
PVIVTPPTKQSLVKV

SEQ ID NO: 2710 - protein, 15 aa, Homo sapiens
PPEVTKIPEDILQLL

SEQ ID NO: 2711 - protein, 15 aa, Homo sapiens
DVNILLDKARLENQE

SEQ ID NO: 2712 - protein, 15 aa, Homo sapiens
ENFQKTDVKDDLSDP

SEQ ID NO: 2713 - protein, 15 aa, Homo sapiens
KSEEAIDTESRLNDN

SEQ ID NO: 2714 - protein, 15 aa, Homo sapiens
SNDLEVEDRTSLVLN

SEQ ID NO: 2715 - protein, 15 aa, Homo sapiens
PMRILYDLHSEVQTL

SEQ ID NO: 2716 - protein, 15 aa, Homo sapiens
KTDVKDDLSDPPVAS

SEQ ID NO: 2717 - protein, 15 aa, Homo sapiens
KCALKMDDFECVTPK

SEQ ID NO: 2718 - protein, 15 aa, Homo sapiens
EVQTLKDDVNILLDK

SEQ ID NO: 2719 - protein, 15 aa, Homo sapiens
RTSLVLNSDTCFENL

SEQ ID NO: 2720 - protein, 15 aa, Homo sapiens
SLVLNSDTCFENLTD

SEQ ID NO: 2721 - protein, 15 aa, Homo sapiens
ATKVLMEKNSMDIMK

SEQ ID NO: 2722 - protein, 15 aa, Homo sapiens
SPTISSYENLLRTPT

SEQ ID NO: 2723 - protein, 15 aa, Homo sapiens
SLASTLDCETARLQR

SEQ ID NO: 2724 - protein, 15 aa, Homo sapiens
VNILLDKARLENQEG

SEQ ID NO: 2725 - protein, 15 aa, Homo sapiens
KARLENQEGIDFIKA

SEQ ID NO: 2726 - protein, 15 aa, Homo sapiens
KNSMDIMKIREYFQK

SEQ ID NO: 2727 - protein, 15 aa, Homo sapiens
SPQLSDFGLERYIVS

SEQ ID NO: 2728 - protein, 15 aa, Homo sapiens
FECVTPKLEHFGISE

SEQ ID NO: 2729 - protein, 15 aa, Homo sapiens
TPKLEHFGISEYTMC

SEQ ID NO: 2730 - protein, 15 aa, Homo sapiens
TMGLKNARNNKSEEA

SEQ ID NO: 2731 - protein, 15 aa, Homo sapiens
EEAIDTESRLNDNVF

SEQ ID NO: 2732 - protein, 15 aa, Homo sapiens
DLEVEDRTSLVLNSD

SEQ ID NO: 2733 - protein, 15 aa, Homo sapiens
EDILQLLSKYNSNLA

SEQ ID NO: 2734 - protein, 15 aa, Homo sapiens
IKAVPPSKRFLKHGQ

SEQ ID NO: 2735 - protein, 15 aa, Homo sapiens
RLQRALDGEESDFED

SEQ ID NO: 2736 - protein, 15 aa, Homo sapiens
LYDLHSEVQTLKDDV

SEQ ID NO: 2737 - protein, 15 aa, Homo sapiens
IMKIREYFQKYGYSP

SEQ ID NO: 2738 - protein, 15 aa, Homo sapiens
SQVLPNPPQAVNNYK

SEQ ID NO: 2739 - protein, 15 aa, Homo sapiens
KQSLVKVLKTPKCAL

SEQ ID NO: 2740 - protein, 15 aa, Homo sapiens
PSPIIQQLEKSDAEY

SEQ ID NO: 2741 - protein, 15 aa, Homo sapiens
QQLEKSDAEYTNSPL

SEQ ID NO: 2742 - protein, 15 aa, Homo sapiens
SPLVPTFCTPGLKIP

SEQ ID NO: 2743 - protein, 15 aa, Homo sapiens
GLKIPSTKNSIALVS

SEQ ID NO: 2744 - protein, 15 aa, Homo sapiens
TNSSSNDLEVEDRTS

SEQ ID NO: 2745 - protein, 15 aa, Homo sapiens
SSPTISSYENLLRTP

SEQ ID NO: 2746 - protein, 15 aa, Homo sapiens
SKRFLKHGQNIRDVS

SEQ ID NO: 2747 - protein, 15 aa, Homo sapiens
ISSYENLLRTPTPPE

SEQ ID NO: 2748 - protein, 15 aa, Homo sapiens
PMRILYDLHSEVQTL

SEQ ID NO: 2749 - protein, 15 aa, Homo sapiens
MRILYDLHSEVQTLK

SEQ ID NO: 2750 - protein, 15 aa, Homo sapiens
LYDLHSEVQTLKDDV

SEQ ID NO: 2751 - protein, 15 aa, Homo sapiens
VQTLKDDVNILLDKA

SEQ ID NO: 2752 - protein, 15 aa, Homo sapiens
TMCLNEDYTMGLKNA

SEQ ID NO: 2753 - protein, 15 aa, Homo sapiens
TMGLKNARNNKSEEA

SEQ ID NO: 2754 - protein, 15 aa, Homo sapiens
SPLVPTFCTPGLKIP

SEQ ID NO: 2755 - protein, 15 aa, Homo sapiens
SNDLEVEDRTSLVLN

SEQ ID NO: 2756 - protein, 15 aa, Homo sapiens
PEDILQLLSKYNSNL

SEQ ID NO: 2757 - protein, 15 aa, Homo sapiens
GIDFIKATKVLMEKN

SEQ ID NO: 2758 - protein, 15 aa, Homo sapiens
FQKYGYSPRVKKNSV

SEQ ID NO: 2759 - protein, 15 aa, Homo sapiens
LSDFGLERYIVSQVL

SEQ ID NO: 2760 - protein, 15 aa, Homo sapiens
VNNYKEEPVIVTPPT

SEQ ID NO: 2761 - protein, 15 aa, Homo sapiens
STNYPLSKTNSSSND

SEQ ID NO: 2762 - protein, 15 aa, Homo sapiens
DTCFENLTDPSSPTI

SEQ ID NO: 2763 - protein, 15 aa, Homo sapiens
CGKLRSLASTLDCET

SEQ ID NO: 2764 - protein, 15 aa, Homo sapiens
ASTLDCETARLQRAL

SEQ ID NO: 2765 - protein, 15 aa, Homo sapiens
QRALDGEESDFEDYP

SEQ ID NO: 2766 - protein, 15 aa, Homo sapiens
DYPMRILYDLHSEVQ

SEQ ID NO: 2767 - protein, 15 aa, Homo sapiens
HSEVQTLKDDVNILL

SEQ ID NO: 2768 - protein, 15 aa, Homo sapiens
NILLDKARLENQEGI

SEQ ID NO: 2769 - protein, 15 aa, Homo sapiens
QEGIDFIKATKVLME

SEQ ID NO: 2770 - protein, 15 aa, Homo sapiens
ATKVLMEKNSMDIMK

SEQ ID NO: 2771 - protein, 15 aa, Homo sapiens
SMDIMKIREYFQKYG

SEQ ID NO: 2772 - protein, 15 aa, Homo sapiens
QEAINSDPELSNCEN

SEQ ID NO: 2773 - protein, 15 aa, Homo sapiens
DPELSNCENFQKTDV

SEQ ID NO: 2774 - protein, 15 aa, Homo sapiens
KTDVKDDLSDPPVAS

SEQ ID NO: 2775 - protein, 15 aa, Homo sapiens
SQVLPNPPQAVNNYK

SEQ ID NO: 2776 - protein, 15 aa, Homo sapiens
EPVIVTPPTKQSLVK

SEQ ID NO: 2777 - protein, 15 aa, Homo sapiens
KQSLVKVLKTPKCAL

SEQ ID NO: 2778 - protein, 15 aa, Homo sapiens
QSLVKVLKTPKCALK

SEQ ID NO: 2779 - protein, 15 aa, Homo sapiens
KCALKMDDFECVTPK

SEQ ID NO: 2780 - protein, 15 aa, Homo sapiens
EEAIDTESRLNDNVF

SEQ ID NO: 2781 - protein, 15 aa, Homo sapiens
NDNVFATPSPIIQQL

SEQ ID NO: 2782 - protein, 15 aa, Homo sapiens
SPIIQQLEKSDAEYT

SEQ ID NO: 2783 - protein, 15 aa, Homo sapiens
TPGLKIPSTKNSIAL

SEQ ID NO: 2784 - protein, 15 aa, Homo sapiens
GLKIPSTKNSIALVS

SEQ ID NO: 2785 - protein, 15 aa, Homo sapiens
KNSIALVSTNYPLSK

SEQ ID NO: 2786 - protein, 15 aa, Homo sapiens
NYPLSKTNSSSNDLE

SEQ ID NO: 2787 - protein, 15 aa, Homo sapiens
SLVLNSDTCFENLTD

SEQ ID NO: 2788 - protein, 15 aa, Homo sapiens
FENLTDPSSPTISSY

SEQ ID NO: 2789 - protein, 15 aa, Homo sapiens
PPEVTKIPEDILQLL

SEQ ID NO: 2790 - protein, 15 aa, Homo sapiens
VTKIPEDILQLLSKY

SEQ ID NO: 2791 - protein, 15 aa, Homo sapiens
EDILQLLSKYNSNLA

SEQ ID NO: 2792 - protein, 15 aa, Homo sapiens
LQLLSKYNSNLATPI

SEQ ID NO: 2793 - protein, 15 aa, Homo sapiens
IKAVPPSKRFLKHGQ

SEQ ID NO: 2794 - protein, 15 aa, Homo sapiens
RSFCGKLRSLASTLD

SEQ ID NO: 2795 - protein, 15 aa, Homo sapiens
LDKARLENQEGIDFI

SEQ ID NO: 2796 - protein, 15 aa, Homo sapiens
INSDPELSNCENFQK

SEQ ID NO: 2797 - protein, 15 aa, Homo sapiens
DLSDPPVASSCISEK

SEQ ID NO: 2798 - protein, 15 aa, Homo sapiens
LSDPPVASSCISEKS

SEQ ID NO: 2799 - protein, 15 aa, Homo sapiens
ASSCISEKSPRSPQL

SEQ ID NO: 2800 - protein, 15 aa, Homo sapiens
QLSDFGLERYIVSQV

SEQ ID NO: 2801 - protein, 15 aa, Homo sapiens
FGLERYIVSQVLPNP

SEQ ID NO: 2802 - protein, 15 aa, Homo sapiens
YIVSQVLPNPPQAVN

SEQ ID NO: 2803 - protein, 15 aa, Homo sapiens
LPNPPQAVNNYKEEP

SEQ ID NO: 2804 - protein, 15 aa, Homo sapiens
YKEEPVIVTPPTKQS

SEQ ID NO: 2805 - protein, 15 aa, Homo sapiens
ECVTPKLEHFGISEY

SEQ ID NO: 2806 - protein, 15 aa, Homo sapiens
EHFGISEYTMCLNED

SEQ ID NO: 2807 - protein, 15 aa, Homo sapiens
EDYTMGLKNARNNKS

SEQ ID NO: 2808 - protein, 15 aa, Homo sapiens
ATPSPIIQQLEKSDA

SEQ ID NO: 2809 - protein, 15 aa, Homo sapiens
YTNSPLVPTFCTPGL

SEQ ID NO: 2810 - protein, 15 aa, Homo sapiens
CTPGLKIPSTKNSIA

SEQ ID NO: 2811 - protein, 15 aa, Homo sapiens
NDLEVEDRTSLVLNS

SEQ ID NO: 2812 - protein, 15 aa, Homo sapiens
EDRTSLVLNSDTCFE

SEQ ID NO: 2813 - protein, 15 aa, Homo sapiens
CFENLTDPSSPTISS

SEQ ID NO: 2814 - protein, 15 aa, Homo sapiens
DPSSPTISSYENLLR

SEQ ID NO: 2815 - protein, 15 aa, Homo sapiens
TKIPEDILQLLSKYN

SEQ ID NO: 2816 - protein, 15 aa, Homo sapiens
SKYNSNLATPIAIKA

SEQ ID NO: 2817 - protein, 15 aa, Homo sapiens
PPSKRFLKHGQNIRD

SEQ ID NO: 2818 - protein, 15 aa, Homo sapiens
IRSFCGKLRSLASTL

SEQ ID NO: 2819 - protein, 15 aa, Homo sapiens
ESDFEDYPMRILYDL

SEQ ID NO: 2820 - protein, 15 aa, Homo sapiens
RILYDLHSEVQTLKD

SEQ ID NO: 2821 - protein, 15 aa, Homo sapiens
LERYIVSQVLPNPPQ

SEQ ID NO: 2822 - protein, 15 aa, Homo sapiens
MDDFECVTPKLEHFG

SEQ ID NO: 2823 - protein, 15 aa, Homo sapiens
ISEYTMCLNEDYTMG

SEQ ID NO: 2824 - protein, 15 aa, Homo sapiens
DNVFATPSPIIQQLE

SEQ ID NO: 2825 - protein, 15 aa, Homo sapiens
DAEYTNSPLVPTFCT

SEQ ID NO: 2826 - protein, 15 aa, Homo sapiens
LSKYNSNLATPIAIK

SEQ ID NO: 2827 - protein, 15 aa, Homo sapiens
SKRFLKHGQNIRDVS

SEQ ID NO: 2828 - protein, 15 aa, Homo sapiens
VNILLDKARLENQEG

SEQ ID NO: 2829 - protein, 15 aa, Homo sapiens
TKVLMEKNSMDIMKI

SEQ ID NO: 2830 - protein, 15 aa, Homo sapiens
DLEVEDRTSLVLNSD

SEQ ID NO: 2831 - protein, 15 aa, Homo sapiens
ILQLLSKYNSNLATP

SEQ ID NO: 2832 - protein, 15 aa, Homo sapiens
MDPIRSFCGKLRSLA

SEQ ID NO: 2833 - protein, 15 aa, Homo sapiens
LRSLASTLDCETARL

SEQ ID NO: 2834 - protein, 15 aa, Homo sapiens
TARLQRALDGEESDF

SEQ ID NO: 2835 - protein, 15 aa, Homo sapiens
KDDVNILLDKARLEN

SEQ ID NO: 2836 - protein, 15 aa, Homo sapiens
DVNILLDKARLENQE

SEQ ID NO: 2837 - protein, 15 aa, Homo sapiens
KVLMEKNSMDIMKIR

SEQ ID NO: 2838 - protein, 15 aa, Homo sapiens
IMKIREYFQKYGYSP

SEQ ID NO: 2839 - protein, 15 aa, Homo sapiens
SPRVKKNSVHEQEAI

SEQ ID NO: 2840 - protein, 15 aa, Homo sapiens
KNSVHEQEAINSDPE

SEQ ID NO: 2841 - protein, 15 aa, Homo sapiens
KDDLSDPPVASSCIS

SEQ ID NO: 2842 - protein, 15 aa, Homo sapiens
DPPVASSCISEKSPR

SEQ ID NO: 2843 - protein, 15 aa, Homo sapiens
SPQLSDFGLERYIVS

SEQ ID NO: 2844 - protein, 15 aa, Homo sapiens
DFGLERYIVSQVLPN

SEQ ID NO: 2845 - protein, 15 aa, Homo sapiens
RYIVSQVLPNPPQAV

SEQ ID NO: 2846 - protein, 15 aa, Homo sapiens
VSQVLPNPPQAVNNY

SEQ ID NO: 2847 - protein, 15 aa, Homo sapiens
PQAVNNYKEEPVIVT

SEQ ID NO: 2848 - protein, 15 aa, Homo sapiens
EEPVIVTPPTKQSLV

SEQ ID NO: 2849 - protein, 15 aa, Homo sapiens
PVIVTPPTKQSLVKV

SEQ ID NO: 2850 - protein, 15 aa, Homo sapiens
LVKVLKTPKCALKMD

SEQ ID NO: 2851 - protein, 15 aa, Homo sapiens
VKVLKTPKCALKMDD

SEQ ID NO: 2852 - protein, 15 aa, Homo sapiens
ALKMDDFECVTPKLE

SEQ ID NO: 2853 - protein, 15 aa, Homo sapiens
TPKLEHFGISEYTMC

SEQ ID NO: 2854 - protein, 15 aa, Homo sapiens
HFGISEYTMCLNEDY

SEQ ID NO: 2855 - protein, 15 aa, Homo sapiens
EYTMCLNEDYTMGLK

SEQ ID NO: 2856 - protein, 15 aa, Homo sapiens
IQQLEKSDAEYTNSP

SEQ ID NO: 2857 - protein, 15 aa, Homo sapiens
SIALVSTNYPLSKTN

SEQ ID NO: 2858 - protein, 15 aa, Homo sapiens
IALVSTNYPLSKTNS

SEQ ID NO: 2859 - protein, 15 aa, Homo sapiens
TSLVLNSDTCFENLT

SEQ ID NO: 2860 - protein, 15 aa, Homo sapiens
SPTISSYENLLRTPT

SEQ ID NO: 2861 - protein, 15 aa, Homo sapiens
YENLLRTPTPPEVTK

SEQ ID NO: 2862 - protein, 15 aa, Homo sapiens
ENLLRTPTPPEVTKI

SEQ ID NO: 2863 - protein, 15 aa, Homo sapiens
NSNLATPIAIKAVPP

SEQ ID NO: 2864 - protein, 15 aa, Homo sapiens
PIAIKAVPPSKRFLK

SEQ ID NO: 2865 - protein, 15 aa, Homo sapiens
KRFLKHGQNIRDVSN

SEQ ID NO: 2866 - protein, 15 aa, Homo sapiens
KYGYSPRVKKNSVHE

SEQ ID NO: 2867 - protein, 15 aa, Homo sapiens
SPIIQQLEKSDAEYT

SEQ ID NO: 2868 - protein, 15 aa, Homo sapiens
EDILQLLSKYNSNLA

SEQ ID NO: 2869 - protein, 15 aa, Homo sapiens
IRSFCGKLRSLASTL

SEQ ID NO: 2870 - protein, 15 aa, Homo sapiens
ISSYENLLRTPTPPE

SEQ ID NO: 2871 - protein, 15 aa, Homo sapiens
DTCFENLTDPSSPTI

SEQ ID NO: 2872 - protein, 15 aa, Homo sapiens
KQSLVKVLKTPKCAL

SEQ ID NO: 2873 - protein, 15 aa, Homo sapiens
NEDYTMGLKNARNNK

SEQ ID NO: 2874 - protein, 15 aa, Homo sapiens
VSTNYPLSKTNSSSN

SEQ ID NO: 2875 - protein, 15 aa, Homo sapiens
GIDFIKATKVLMEKN

SEQ ID NO: 2876 - protein, 15 aa, Homo sapiens
FQKYGYSPRVKKNSV

SEQ ID NO: 2877 - protein, 15 aa, Homo sapiens
DYPMRILYDLHSEVQ

SEQ ID NO: 2878 - protein, 15 aa, Homo sapiens
RYIVSQVLPNPPQAV

SEQ ID NO: 2879 - protein, 15 aa, Homo sapiens
KNSIALVSTNYPLSK

SEQ ID NO: 2880 - protein, 15 aa, Homo sapiens
IREYFQKYGYSPRVK

SEQ ID NO: 2881 - protein, 15 aa, Homo sapiens
LSDFGLERYIVSQVL

SEQ ID NO: 2882 - protein, 15 aa, Homo sapiens
PPTKQSLVKVLKTPK

SEQ ID NO: 2883 - protein, 15 aa, Homo sapiens
MDDFECVTPKLEHFG

SEQ ID NO: 2884 - protein, 15 aa, Homo sapiens
VPTFCTPGLKIPSTK

SEQ ID NO: 2885 - protein, 15 aa, Homo sapiens
DPIRSFCGKLRSLAS

SEQ ID NO: 2886 - protein, 15 aa, Homo sapiens
DDVNILLDKARLENQ

SEQ ID NO: 2887 - protein, 15 aa, Homo sapiens
EKNSMDIMKIREYFQ

SEQ ID NO: 2888 - protein, 15 aa, Homo sapiens
QLSDFGLERYIVSQV

SEQ ID NO: 2889 - protein, 15 aa, Homo sapiens
PVIVTPPTKQSLVKV

SEQ ID NO: 2890 - protein, 15 aa, Homo sapiens
PTFCTPGLKIPSTKN

SEQ ID NO: 2891 - protein, 15 aa, Homo sapiens
STNYPLSKTNSSSND

SEQ ID NO: 2892 - protein, 15 aa, Homo sapiens
DCETARLQRALDGEE

SEQ ID NO: 2893 - protein, 15 aa, Homo sapiens
NFQKTDVKDDLSDPP

SEQ ID NO: 2894 - protein, 15 aa, Homo sapiens
SNDLEVEDRTSLVLN

SEQ ID NO: 2895 - protein, 15 aa, Homo sapiens
PPEVTKIPEDILQLL

SEQ ID NO: 2896 - protein, 15 aa, Homo sapiens
NLATPIAIKAVPPSK

SEQ ID NO: 2897 - protein, 15 aa, Homo sapiens
IKAVPPSKRFLKHGQ

SEQ ID NO: 2898 - protein, 15 aa, Homo sapiens
FLKHGQNIRDVSNKE

SEQ ID NO: 2899 - protein, 15 aa, Homo sapiens
PMRILYDLHSEVQTL

SEQ ID NO: 2900 - protein, 15 aa, Homo sapiens
VNILLDKARLENQEG

SEQ ID NO: 2901 - protein, 15 aa, Homo sapiens
KATKVLMEKNSMDIM

SEQ ID NO: 2902 - protein, 15 aa, Homo sapiens
YGYSPRVKKNSVHEQ

SEQ ID NO: 2903 - protein, 15 aa, Homo sapiens
ERYIVSQVLPNPPQA

SEQ ID NO: 2904 - protein, 15 aa, Homo sapiens
PPQAVNNYKEEPVIV

SEQ ID NO: 2905 - protein, 15 aa, Homo sapiens
QSLVKVLKTPKCALK

SEQ ID NO: 2906 - protein, 15 aa, Homo sapiens
LVKVLKTPKCALKMD

SEQ ID NO: 2907 - protein, 15 aa, Homo sapiens
FECVTPKLEHFGISE

SEQ ID NO: 2908 - protein, 15 aa, Homo sapiens
ECVTPKLEHFGISEY

SEQ ID NO: 2909 - protein, 15 aa, Homo sapiens
EEAIDTESRLNDNVF

SEQ ID NO: 2910 - protein, 15 aa, Homo sapiens
ESRLNDNVFATPSPI

SEQ ID NO: 2911 - protein, 15 aa, Homo sapiens
TPTPPEVTKIPEDIL

SEQ ID NO: 2912 - protein, 15 aa, Homo sapiens
PPSKRFLKHGQNIRD

SEQ ID NO: 2913 - protein, 15 aa, Homo sapiens
CGKLRSLASTLDCET

SEQ ID NO: 2914 - protein, 15 aa, Homo sapiens
MRILYDLHSEVQTLK

SEQ ID NO: 2915 - protein, 15 aa, Homo sapiens
HSEVQTLKDDVNILL

SEQ ID NO: 2916 - protein, 15 aa, Homo sapiens
LKDDVNILLDKARLE

SEQ ID NO: 2917 - protein, 15 aa, Homo sapiens
LENQEGIDFIKATKV

SEQ ID NO: 2918 - protein, 15 aa, Homo sapiens
QEGIDFIKATKVLME

SEQ ID NO: 2919 - protein, 15 aa, Homo sapiens
IKATKVLMEKNSMDI

SEQ ID NO: 2920 - protein, 15 aa, Homo sapiens
KNSMDIMKIREYFQK

SEQ ID NO: 2921 - protein, 15 aa, Homo sapiens
SSCISEKSPRSPQLS

SEQ ID NO: 2922 - protein, 15 aa, Homo sapiens
GLERYIVSQVLPNPP

SEQ ID NO: 2923 - protein, 15 aa, Homo sapiens
TMGLKNARNNKSEEA

SEQ ID NO: 2924 - protein, 15 aa, Homo sapiens
GLKIPSTKNSIALVS

SEQ ID NO: 2925 - protein, 15 aa, Homo sapiens
SIALVSTNYPLSKTN

SEQ ID NO: 2926 - protein, 15 aa, Homo sapiens
SSNDLEVEDRTSLVL

SEQ ID NO: 2927 - protein, 15 aa, Homo sapiens
TKIPEDILQLLSKYN

SEQ ID NO: 2928 - protein, 15 aa, Homo sapiens
LQLLSKYNSNLATPI

SEQ ID NO: 2929 - protein, 15 aa, Homo sapiens
SKYNSNLATPIAIKA

SEQ ID NO: 2930 - protein, 15 aa, Homo sapiens
NSNLATPIAIKAVPP

SEQ ID NO: 2931 - protein, 15 aa, Homo sapiens
PIAIKAVPPSKRFLK

SEQ ID NO: 2932 - protein, 29 aa, Artificial Sequence
  Description of Artificial Sequence: 193P1E1b version 2 amino acid sequence
DDLSDPPVASSCISGKSPRSPQLSDFGLE

SEQ ID NO: 2933 - protein, 15 aa, Homo sapiens
PVASSCISGKSPRSP

SEQ ID NO: 2934 - protein, 15 aa, Homo sapiens
SSCISGKSPRSPQLS

SEQ ID NO: 2935 - protein, 15 aa, Homo sapiens
DLSDPPVASSCISGK

SEQ ID NO: 2936 - protein, 15 aa, Homo sapiens
DLSDPPVASSCISGK

SEQ ID NO: 2937 - protein, 15 aa, Homo sapiens
LSDPPVASSCISGKS

SEQ ID NO: 2938 - protein, 15 aa, Homo sapiens
DPPVASSCISGKSPR

SEQ ID NO: 2939 - protein, 15 aa, Homo sapiens
SSCISGKSPRSPQLS

SEQ ID NO: 2940 - protein, 29 aa, Artificial Sequence
  Description of Artificial Sequence: 193P1E1b variant 3 amino acid sequence
LKNARNNKSEEAIDTESRLNDNVFATPSP

SEQ ID NO: 2941 - protein, 15 aa, Homo sapiens
LKNARNNKSEEAIDT

SEQ ID NO: 2942 - protein, 15 aa, Homo sapiens
IDTESRLNDNVFATP

SEQ ID NO: 2943 - protein, 15 aa, Homo sapiens
KSEEAIDTESRLNDN

SEQ ID NO: 2944 - protein, 15 aa, Homo sapiens
EEAIDTESRLNDNVF

SEQ ID NO: 2945 - protein, 15 aa, Homo sapiens
EEAIDTESRLNDNVF

SEQ ID NO: 2946 - protein, 15 aa, Homo sapiens
EEAIDTESRLNDNVF

SEQ ID NO: 2947 - protein, 29 aa, Artificial Sequence
  Description of Artificial Sequence:193P1E1b variants 4 and 5 amino acid sequence
TPPEVTKIPEDILQKFQWIYPTQKLNKMR

SEQ ID NO: 2948 - protein, 15 aa, Homo sapiens
PPEVTKIPEDILQKF

SEQ ID NO: 2949 - protein, 15 aa, Homo sapiens
LQKFQWIYPTQKLNK

SEQ ID NO: 2950 - protein, 15 aa, Homo sapiens
EDILQKFQWIYPTQK

SEQ ID NO: 2951 - protein, 15 aa, Homo sapiens
QKFQWIYPTQKLNKM

SEQ ID NO: 2952 - protein, 15 aa, Homo sapiens
VTKIPEDILQKFQWI

SEQ ID NO: 2953 - protein, 15 aa, Homo sapiens
VTKIPEDILQKFQWI

SEQ ID NO: 2954 - protein, 15 aa, Homo sapiens
PPEVTKIPEDILQKF

SEQ ID NO: 2955 - protein, 15 aa, Homo sapiens
PEDILQKFQWIYPTQ

SEQ ID NO: 2956 - protein, 15 aa, Homo sapiens
LQKFQWIYPTQKLNK

SEQ ID NO: 2957 - protein, 15 aa, Homo sapiens
KFQWIYPTQKLNKMR

SEQ ID NO: 2958 - protein, 15 aa, Homo sapiens
PPEVTKIPEDILQKF

SEQ ID NO: 2959 - protein, 15 aa, Homo sapiens
TKIPEDILQKFQWIY

SEQ ID NO: 2960 - protein, 15 aa, Homo sapiens
VTKIPEDILQKFQWI

SEQ ID NO: 2961 - protein, 15 aa, Homo sapiens
EDILQKFQWIYPTQK

SEQ ID NO: 2962 - protein, 15 aa, Homo sapiens
LQKFQWIYPTQKLNK

SEQ ID NO: 2963 - protein, 15 aa, Homo sapiens
PPEVTKIPEDILQKF

SEQ ID NO: 2964 - protein, 15 aa, Homo sapiens
KIPEDILQKFQWIYP

SEQ ID NO: 2965 - protein, 28 aa, Artificial Sequence
  Description of Artificial Sequence: 193P1E1b variant 6 amino acid sequence
ETARLQRALDGEESLLSKYNSNLATPIA

SEQ ID NO: 2966 - protein, 15 aa, Homo sapiens
ARLQRALDGEESLLS

SEQ ID NO: 2967 - protein, 15 aa, Homo sapiens
ESLLSKYNSNLATPI

SEQ ID NO: 2968 - protein, 15 aa, Homo sapiens
QRALDGEESLLSKYN

SEQ ID NO: 2969 - protein, 15 aa, Homo sapiens
DGEESLLSKYNSNLA

SEQ ID NO: 2970 - protein, 15 aa, Homo sapiens
EESLLSKYNSNLATP

SEQ ID NO: 2971 - protein, 15 aa, Homo sapiens
EESLLSKYNSNLATP

SEQ ID NO: 2972 - protein, 15 aa, Homo sapiens
RLQRALDGEESLLSK

SEQ ID NO: 2973 - protein, 15 aa, Homo sapiens
LQRALDGEESLLSKY

SEQ ID NO: 2974 - protein, 15 aa, Homo sapiens
QRALDGEESLLSKYN

SEQ ID NO: 2975 - protein, 15 aa, Homo sapiens
ESLLSKYNSNLATPI

SEQ ID NO: 2976 - protein, 15 aa, Homo sapiens
LDGEESLLSKYNSNL

SEQ ID NO: 2977 - protein, 15 aa, Homo sapiens
EESLLSKYNSNLATP

SEQ ID NO: 2978 - protein, 15 aa, Homo sapiens
TARLQRALDGEESLL

SEQ ID NO: 2979 - protein, 15 aa, Homo sapiens
DGEESLLSKYNSNLA

SEQ ID NO: 2980 - protein, 15 aa, Homo sapiens
QRALDGEESLLSKYN

SEQ ID NO: 2981 - protein, 15 aa, Homo sapiens
ESLLSKYNSNLATPI

SEQ ID NO: 2982 - DNA, 227 bp, Unknown Organism
  Description of Unknown Organism: 193P1E1B SSH nucleotide sequence
  modified_base (177): a, t, c, g, other or unknown
gatccactggaatttcagttttctttgttgctgacatctcggatgttctgtccatgtttagggaaccttttactgggtggcactgctttaattgctattggagtagctaggtttgagttgtattttgatagaagctggagaatatcttctggaattttagttacttctggagggggnaggttctgagcagattctcataagaagaaatcgtaggtgaaagagggatc

SEQ ID NO: 2983 - protein, 412 aa, Unknown Organism
  Description of Unknown Organism: 193P1E1B v.1 amino acid sequence
MDPIRSFCGKLRSLASTLDCETARLQRALDGEESDFEDYPMRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQLLSKYNSNLATPIAIKAVPPSKRFLKHGQNIRDVSNKEN

SEQ ID NO: 2984 - DNA, 2798 bp, Unknown Organism
  Description of Unknown Organism: 193P1E1B v.2 cDNA sequence
  CDS (805)..(2040)
tatcatctgtgactgaggaaatccctatcttcctatcagactaatgaaaccacaggacagcaattagacttttaagtattggggggtttagagctctagatattcgatatgcagactactcatgtttgtttgttttaataaagactggtccaaaggctcattttcacacaagctacagtttttcagttccaggaccaggtaaagatggtcagctccgtgatccataaaatccaagggtgacgactcaggattaggaccatttcttggtgacattgagatggtcgagctggtccgcaatgaatctatgcggggggaacttggaagtggcggccgcctttatggcctcgaaggcctccctcctgcgcaccgcggcgtggccgcgctcctgctcccgggtcatgtagggcatgctcagccagtaatggttctccgcctcgatctccaggcggcggatcatgttctgcttggcgcgcaacgacacgaaccgcggccgccggtgcttcccgatccactgacggccgggaatgcggccgcgccagaggagcgcagtcaggaacatggtgcctgccgcgctgctcaagactctgcgtctccgcggccgccagcagacgccgtggcgtaagcgcacccgtctcgcggggtctccgggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgggaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccagaagtaactaaaattccagaagatattctccagcttttatcaaaatacaactcaaacctagctactccaatagcaattaaagcagtgccacccagtaaaaggttccttaaacatggacagaacatccgagatgtcagcaacaaagaaaactgaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggactattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaacagagggagatttccaggcctgggtaactatatactgtgaccattggcggttgagaccggtcttcaaccagtggaaccccgaactctgctgtcagggtgtggacttcggtgctcttccaagttttcacctgggggggggagctaaccccctatgttcacgccttctattcccattggcgctgaactcttaaggtcactctggtcgcttgtgaccccgtaaccctgatgtacccctctaaaaggtgaggggc

SEQ ID NO: 2985 - protein, 412 aa, Unknown Organism
  Description of Unknown Organism: 193P1E1B v.2 amino acid sequence
MDPIRSFCGKLRSLASTLDCETARLQRALDGEESDFEDYPMRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISGKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQLLSKYNSNLATPIAIKAVPPSKRFLKHGQNIRDVSNKEN

SEQ ID NO: 2986 - DNA, 1177 bp, Unknown Organism
  Description of Unknown Organism: 193P1E1B v.3 cDNA sequence
  CDS (185)..(1174)
atggaccctatccggagcttctgcgggaagctgcggtctctggccagcacgctggactgcgagacggcccggctgcagcgagcgctggacggagaggaaagcggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatgcagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccagaagtaactaaaattccagaagatattctccagcttttatcaaaatacaactcaaacctagctactccaatagcaattaaagcagtgccacccagtaaaaggttccttaaacatggacagaacatccgagatgtcagcaacaaagaaaactga

SEQ ID NO: 2987 - protein, 384 aa, Unknown Organism
  Description of Unknown Organism: 193P1E1 v.3 amino acid sequence
LDCETARLQRALDGEESDFEDYPMRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISGKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDAESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQLLSKYNSNLATPIAIKAVPPSKRFLKHG

SEQ ID NO: 2988 - protein, 364 aa, Unknown Organism
  Description of Unknown Organism: DRADA (P55265) amino acid sequence
VDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHG

SEQ ID NO: 2989 - protein, 330 aa, Unknown Organism; identical to SEQ ID NO: 1310
  Description of Unknown Organism: Subject amino acid sequence

SEQ ID NO: 2990 - protein, 6 aa, Artificial Sequence
  Description of Artificial Sequence: 6X His tag
HHHHHH

SEQ ID NO: 2991 - protein, 14 aa, Clostridium tetani
QYIKANSKFIGITE

SEQ ID NO: 2992 - protein, 21 aa, Plasmodium falciparum
DIEKKIAKMEKASSVFNVVNS

SEQ ID NO: 2993 - protein, 16 aa, Streptococcus sp.
GAVDSILGGVATYGAA

SEQ ID NO: 2994 - protein, 13 aa, Artificial Sequence
  Description of Artificial Sequence: Pan-DR-binding epitope peptide
  MOD_RES (3): Cyclohexylalanine, phenylalanine, or tyrosine
AKXVAAWTLKAAA

SEQ ID NO: 2995 - DNA, 43 bp, Artificial Sequence
  Description of Artificial Sequence: Primer
ttttgatcaagcttttttttttttttttttttttttttttttt

SEQ ID NO: 2996 - DNA, 42 bp, Artificial Sequence
  Description of Artificial Sequence: Adaptor 1 sequence
ctaatacgactcactatagggctcgagcggccgcccgggcag

SEQ ID NO: 2997 - DNA, 12 bp, Artificial Sequence
  Description of Artificial Sequence: Adaptor 1 sequence
gatcctgcccgg

SEQ ID NO: 2998 - DNA, 40 bp, Artificial Sequence
  Description of Artificial Sequence: Adaptor 2 sequence
gtaatacgactcactatagggcagcgtggtcgcggccgag

SEQ ID NO: 2999 - DNA, 10 bp, Artificial Sequence
  Description of Artificial Sequence: Adaptor 2 sequence
gatcctcggc

SEQ ID NO: 3000 - DNA, 22 bp, Artificial Sequence
  Description of Artificial Sequence: Primer
ctaatacgactcactatagggc

SEQ ID NO: 3001 - DNA, 22 bp, Artificial Sequence
  Description of Artificial Sequence: Primer
tcgagcggccgcccgggcagga

SEQ ID NO: 3002 - DNA, 20 bp, Artificial Sequence
  Description of Artificial Sequence: Primer
agcgtggtcgcggccgagga

SEQ ID NO: 3003 - DNA, 25 bp, Artificial Sequence
  Description of Artificial Sequence: Primer
atatcgccgcgctcgtcgtcgacaa

SEQ ID NO: 3004 - DNA, 26 bp, Artificial Sequence
  Description of Artificial Sequence: Primer
agccacacgcagctcattgtagaagg

SEQ ID NO: 3005 - DNA, 24 bp, Artificial Sequence
  Description of Artificial Sequence: Flag sequence
gattacaaggatgacgacgataag

The invention claimed is:

1. A composition comprising an isolated or recombinant 193P1E1B protein comprising the amino acid sequence selected from the group consisting of SEQ ID NO: 2983 and 2985.

2. The composition of claim 1, further comprising a pharmaceutically acceptable carrier.

3. The composition of claim 1, where the isolated or recombinant protein is labeled with a detectable marker.

4. The composition of claim 1 comprising SEQ ID NO:2985.

5. The composition of claim 1 comprising SEQ ID NO: 2983.

* * * * *